United States Patent
Garry et al.

(10) Patent No.: US 11,859,213 B2
(45) Date of Patent: Jan. 2, 2024

(54) DEVELOPMENT OF SUPERIOR CHIMERISM BY HIPSC ENGINEERING AND EMBRYO AGGREGATION

(71) Applicant: Regents of the University of Minnesota, Minneapolis, MN (US)

(72) Inventors: Daniel J. Garry, Eagen, MN (US); Mary G. Garry, Eagan, MN (US); Geunho Maeng, Falcon Heights, MN (US); Ohad Gafni, Minnetonka, MN (US)

(73) Assignee: Regents of the University of Minnesota, Minneapolis, MN (US)

( * ) Notice: Subject to any disclaimer, the term of this patent is extended or adjusted under 35 U.S.C. 154(b) by 612 days.

(21) Appl. No.: 16/877,294

(22) Filed: May 18, 2020

(65) Prior Publication Data

US 2021/0002616 A1    Jan. 7, 2021

Related U.S. Application Data

(60) Provisional application No. 62/848,904, filed on May 16, 2019.

(51) Int. Cl.
*C12N 5/074* (2010.01)
*A01K 67/027* (2006.01)

(52) U.S. Cl.
CPC ........ *C12N 5/0696* (2013.01); *A01K 67/0271* (2013.01); *A01K 67/0276* (2013.01); *A01K 2217/075* (2013.01); *C12N 2506/03* (2013.01)

(58) Field of Classification Search
CPC .............. C12N 5/0696; A01K 67/0271; A01K 67/0276; A01K 2217/075
See application file for complete search history.

(56) References Cited

U.S. PATENT DOCUMENTS

| | | | |
|---|---|---|---|
| 7,683,236 B2 | 3/2010 | Boiani et al. | |
| 2005/0138680 A1 | 6/2005 | Lee et al. | |
| 2018/0360004 A1 | 12/2018 | Nakauchi et al. | |

FOREIGN PATENT DOCUMENTS

| | | |
|---|---|---|
| WO | 2009001359 | 12/2008 |
| WO | 2015168125 | 11/2015 |
| WO | 2016077429 | 5/2016 |
| WO | 2017075276 | 5/2017 |

OTHER PUBLICATIONS

Masaki (Cell Stem Cell, 22016, 19:587-592).*
Kim (2016, International Journal of Molecular Sciences, 17:1533, 11 pages).*
Setoguchi (2016, Journal of Molecular Biology, 428:1465-1475).*
Green (2009, Nature, 458:1127-1130).*
Ardehali, Reza, "Overexpression of BCL2 enhances survival of human embryonic stem cells during stress and obviates the requirement for serum factors", Proc. Natl. Acad. Sci. USA, 108(8), (2011), 3282-3287.
Hong, Hyenjong, "Suppression of Indued Pluripotent Stem Cell Generation by the p53-p21 Pathway", NIH Public Access, Author Manuscript, published in final edited form as Nature, 460(7259) (2009), 1132-1135, (2009), 13 pgs.
Kawamata, Masaki, "Two distinct knockout approaches highlight a critical role for p53 in rat development", Scientific Reports, 2: 945, (2012), 1-10.
Masaki, Hideki, "Inhibition of Apoptosis Overcomes Stage-Related Compatibility Barriers to Chimera Formation in Mouse Embryos", Cell Stem Cell, 19(5), (2016), P587-592.
Tanaka, Mika, "Aggregation Chimeras: Combining ES Cells, Diploid, and Tetraploid Embryos", Methods Mol. Biol., 530, (2009), 287-309, (2009), 23 pgs.
Willis, A., "Mutant p53 exerts a dominant negative effect by preventing wild-type p53 from binding to the promoter of its target genes", Oncogene, 33(13), (2004), 2330-2338.

* cited by examiner

*Primary Examiner* — Valarie E Bertoglio
(74) *Attorney, Agent, or Firm* — Schwegman Lundberg & Woessner, P.A.

(57) ABSTRACT

Provided herein are method to increase the efficiency of interspecies chimera generation.

12 Claims, 15 Drawing Sheets

Specification includes a Sequence Listing.

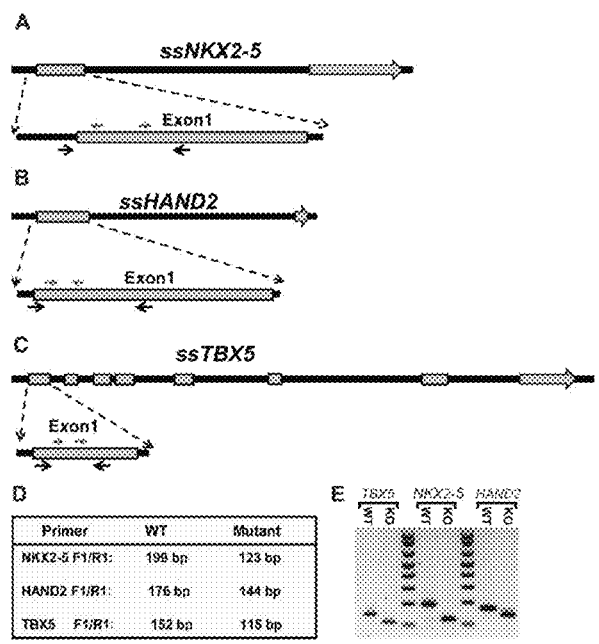
FIG. 9A-D
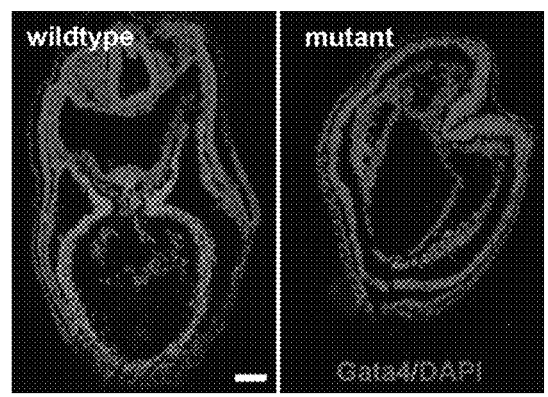
FIG. 10

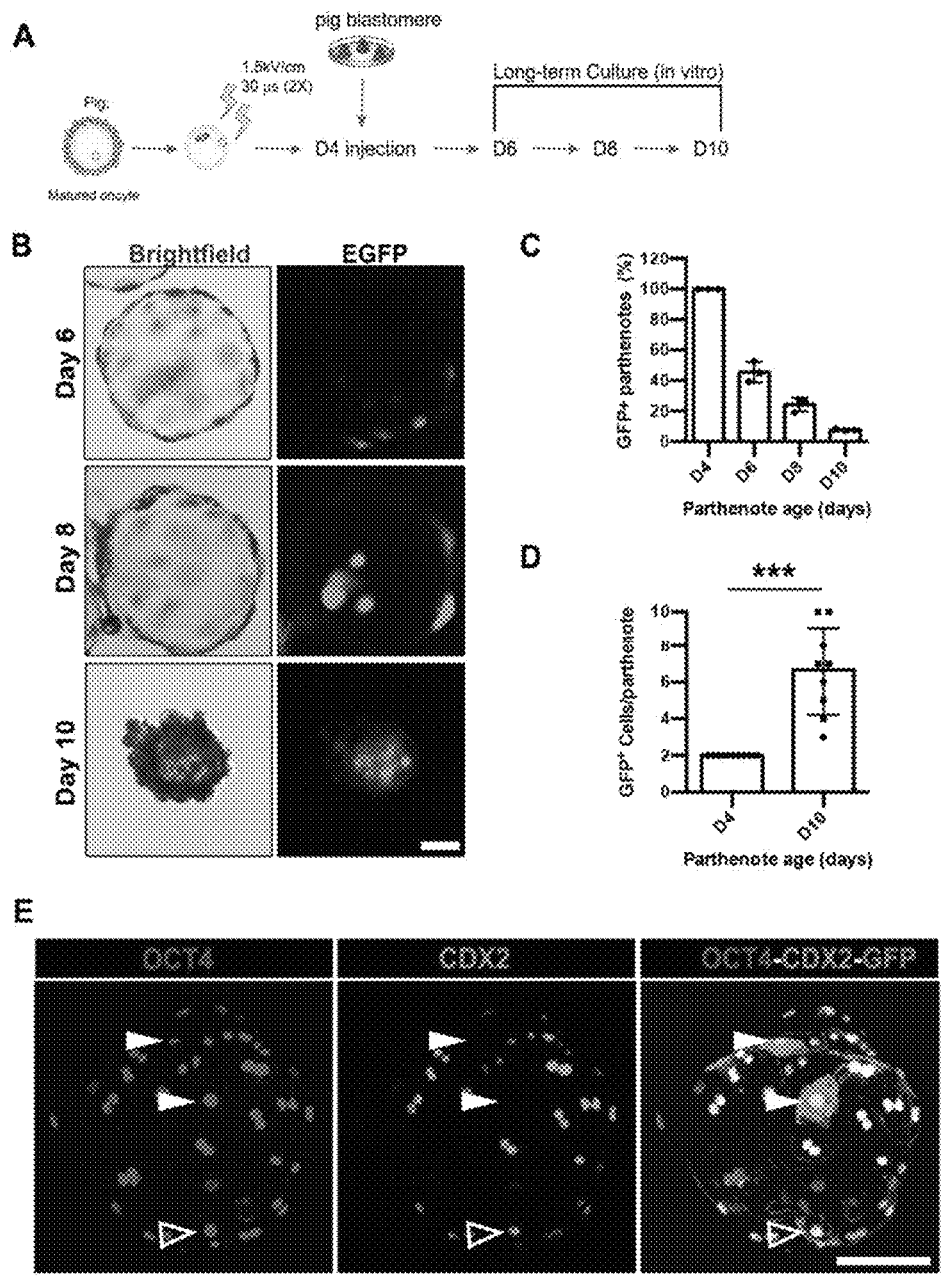
FIG. 11A-E

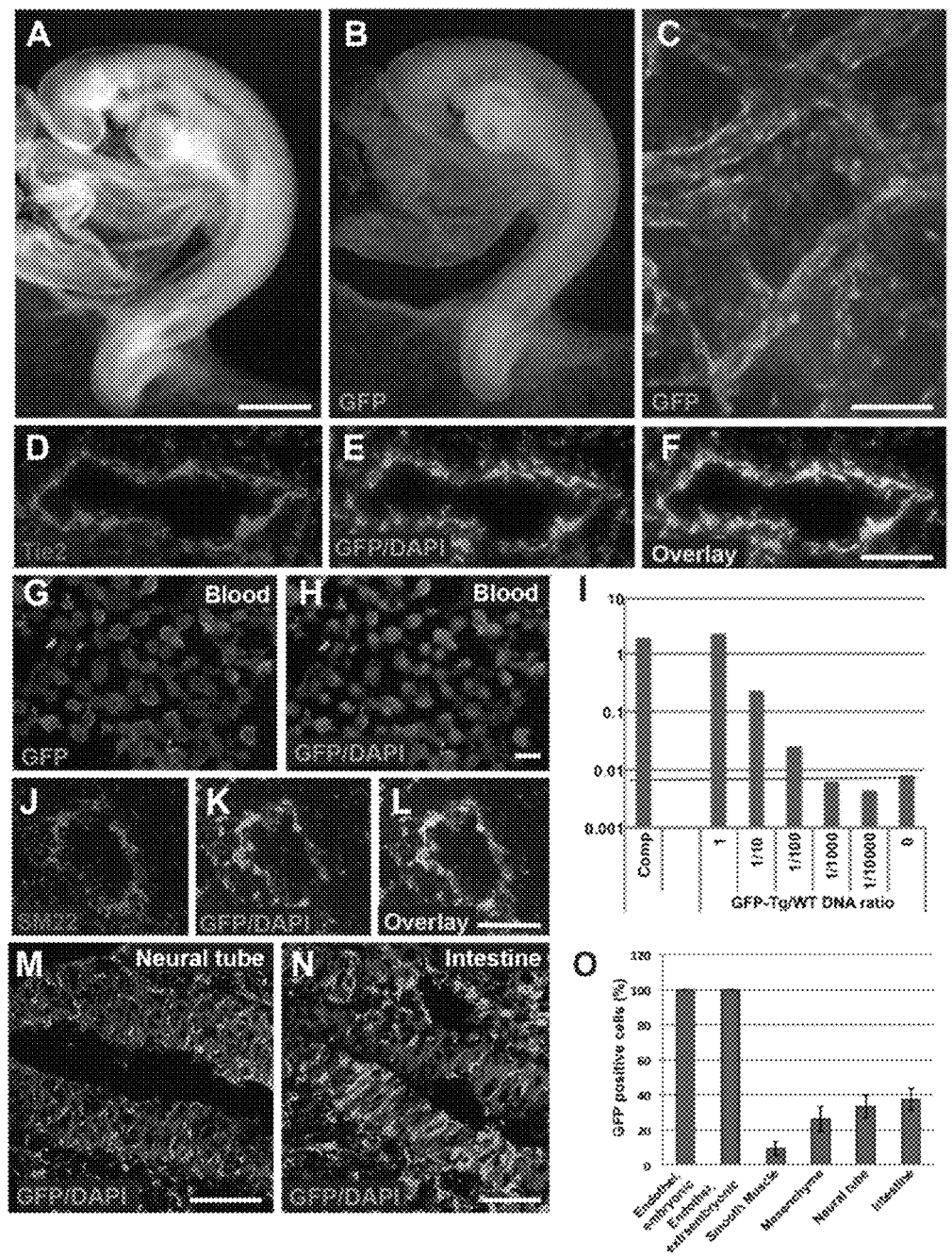
FIG. 12A-O

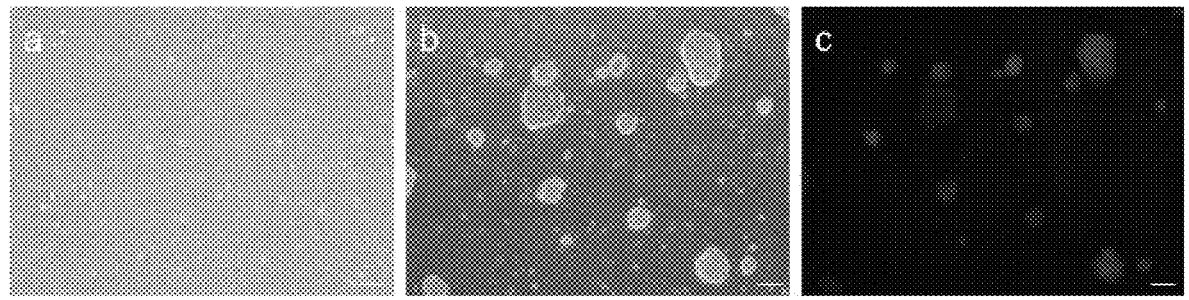
FIG. 13A-C
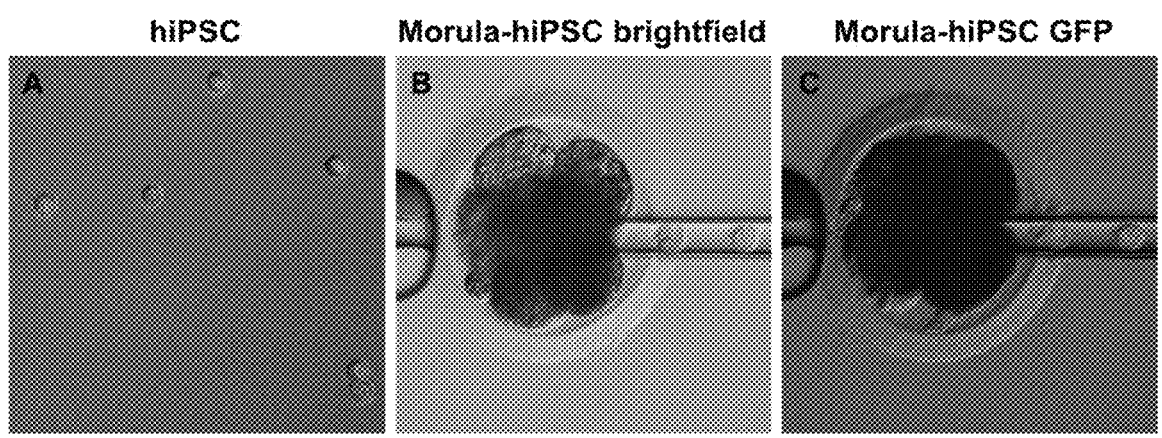
FIG. 14A-C

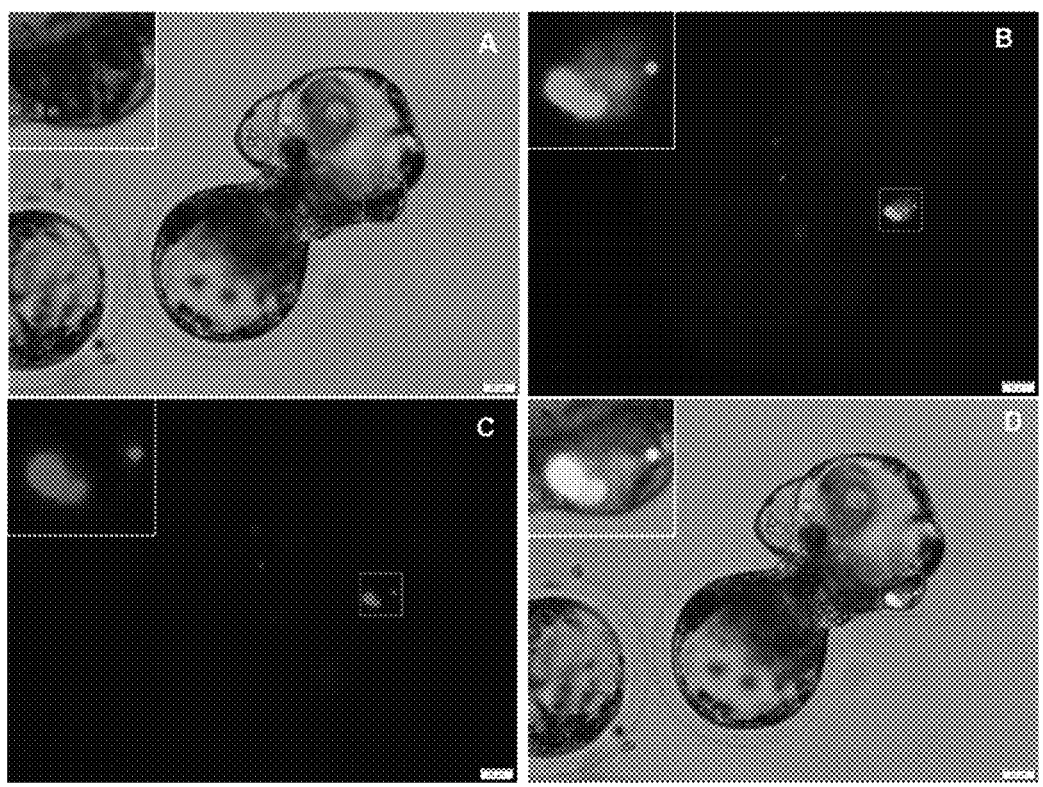
FIG. 15A-D
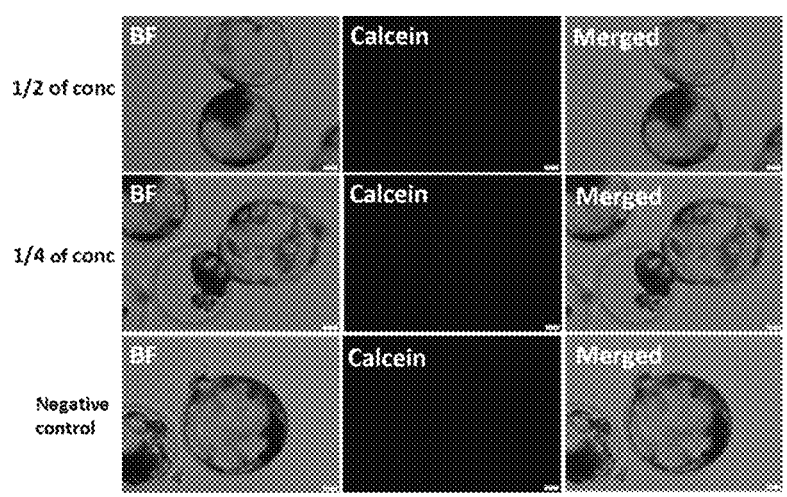
FIG. 16

FIG. 17A-D

DEVELOPMENT OF SUPERIOR CHIMERISM BY HIPSC ENGINEERING AND EMBRYO AGGREGATION

PRIORITY

This application claims the benefit of priority of U.S. Provisional Patent Application No. 62/848,904, filed 16 May 2019, the benefit of priority of which is claimed hereby, and which is incorporated by reference herein in its entirety.

BACKGROUND OF THE INVENTION

Although previous studies support the notion of engineering exogenous organs in animals by using human pluripotent stem cells, the efficiency of this chimerism makes the engineering of chimeric animals expensive and challenging. Additionally, the potential for retention of host-derived endothelium, capable of eliciting a hyperacute rejection following transplantation (1, 2), is not desirable.

SUMMARY OF THE INVENTION

Provided herein is a human stem cell or induced human pluripotent stem cell (iPSC) which overexpresses BCL2 and/or has reduced expression of TP53.

One embodiment provides a method to increase the efficiency of human:non-human animal chimera generation comprising introducing one or more human cells into a non-human embryo, wherein multiple embryos are dissociated and the dissociated aggregate is layered with one or more human cells and cultured prior to transfer into a synchronized gilt, wherein the aggregated embryo and cells results in increased efficiency of chimera generation, further comprising knocking down or out the expression of TP53 and/or overexpression BCL-2 in the one or more human cells. In one embodiment, BCL-2 is overexpressed. In another embodiment, TP53 expression is reduced/knocked down. In one embodiment, BCL-2 is overexpressed and TP53 expression is reduced/knocked down. In one embodiment, the cells are induced human pluripotent stem cells (hiPSCs). In another embodiment, the cells are human stem cells, such as iPSCs, ESC or adult stem cells. In another embodiment, the cells are human umbilical blood cells or non-human primate cells.

In one embodiment, one or both alleles of ETV2, NKX2-5, HandII, TBX5, MYF5, MYOD, MRF4, IL2Rgy/−, RAG2−/−, IL2Rg−/−; RAG2−/−, IL2Rgy/−, RAG2−/−, IL2Rg+/−, RAG2+/−, IL2Rgy/+; RAG2+/−, IL2Rg+/−; RAG2+/−, DGAT (diglyceride acyltransferase), ABCG2 (ATP-binding cassette sub-family G member 2), ACAN (aggrecan), AMELY (amelogenin, y-linked), BLG (progestagen-associated endometrial protein), BMP 1B (FecB) (bone morphogenetic protein receptor, type 1B), DAZL (deleted in azoospermia like), Eif4GI (eukaryotic translation initiation factor 4 gamma, 1), GDF8 (growth/differentiation factor 8), Horn-poll locus, IGF2 (insulin-like growth factor 2), CWC15 (CWC15 spliceosome associated protein), KissR/GRP54 (kisspeptin), OFD1Y (Y-linked oral-facial-digital syndrome 1 pseudogene), p65 (v-rel reticuloendotheliosis viral oncogene homolog A), PRLR (prolactin receptor), Prmd14 (PR domain containtin 14), PRNP (prion protein), Rosa, Socs2 (suppressor of cytokine signaling 2), SRY (sex determining region of Chr Y), ZFY (zinc finger protein, y-linked), β-lactoglobulin, callipyg (CLPG), MODY 1 (HNF4α) (hepatocyte nuclear factor 4, alpha), MODY 2 (GCK) (glucokinase), MODY 3 (HNF1a) (hepatocyte nuclear factor 4, alpha), MODY 4, MODY 5 (HNF-1β) (HNF1 homeobox B), MODY 6 (eurogenic differentiation 1), MODY 7 (KLF11) (Kruppel-like factor 11), MODY 8 (CEL) (carboxyl ester lipase), MODY 9 (PAX4) (paired box 4), MODY 10 (INS) (insulin), MODY 11 (BLK) (BLK proto-oncogene, Src family tyrosine kinase), APC (adenomatosis polyposis *coli*), ApoE (apolipoprotein E), DMD (dystrophin muscular dystrophy), GHRHR (growth hormone releasing hormone receptor), HR (hair growth associated), HSD11B2 (hydroxysteroid (11-beta) dehydrogenase 2), LDLR (low density lipoprotein receptor), NF1 (neurofibromin 1), NPPA (natriuretic peptide A), NR3C2 (nuclear receptor subfamily 3, group C, member 2), p53 (cellular tumor antigen p53-like), PKD1 (polycystic kidney disease 1), Rbm20 (RNA binding motif protein 20), SCNN1G (sodium channel, non-voltage gated 1 gamma subunit), tP53 (tumor protein p53), FAH (fumarylacetoacetate hydrolase), HBB (hemoglobin beta), IL2RG (interleukin 2 receptor, gamma chain), GGTA (bifunctional cephalosporin acylase/gamma-glutamyltranspetidase), VASA (vasa protein), MIWI (piwi-like RNA-mediated gene silencing 1), PIWI (CG6122 gene product from transcript CG6122-RA), DCAF17 (DDB1 and CUL4 associated factor 17), VDR (vitamin D receptor), PNPLA1 (patatin-like phospholipase domain containing 1), HRAS (Harvey rat sarcoma viral oncogene homolog), Telomerase-vert, DSP (desmoplakin), SNRPE (small nuclear ribonucleoprotein polypeptide E), RPL21 (ribosomal protein), LAMA3 (laminin, alpha 3), UROD (uroporphyrinogen decarboxylase), EDAR (ectodysplasin-A receptor), OFD1 (oral-facial-digital syndrome 1), PEX7 (peroxisomal biogenesis factor 7), COL3A1 (collagen, type III, alpha 1), ALOX12B (arachidonate 12lipoxygenase 12R type), HLCS (holocarboxylase synthetase (biotin-(proprionyl-CoA-carboxylase)ATP-hydrolysing)) ligase)), NIPAL4 (NIPA-like domain containing 4), CERS3 (ceramide synthase 3), ANTXR1 (anthrax toxin receptor 1), B3GALT6 (UDP-Gal:betaGA1 beta 1,3 galactosyltransferase polypeptide 6), DSG4 (desmoglein 4), UBR1 (ubiquitin protein ligase E3 component n-recognin 1), CTC1 (CTS telomere maintenance complex component 1), MBTPS2 (membrane-bound transcription factor peptidase, site 2), UROS (uroporphyrinogen III synthase), ABHDS (abhydrolase domain containing 5), NOP10 (NOP10 ribonucleoprotein), ALMS1 (Alstrom syndrome protein 1), LAMB3 (laminin, beta 3), EOGT (EGF domain-specific O-linked N-acetylglucosamine (GlcNAc)), SAT1 (spermindine/spermine N1-acetyltransferase 1), RBPJ (recombination signal binding protein for immunoglobulin kappa J region), ARHGAP31 (Rho GTPase activating protein 31), ACVR1 (activin A receptor, type I), IKBKG (inhibitor of kappa light polypeptide gene enhancer in B-cells, kinase gamma), LPAR6 (lysophosphatidic acid receptor 6), HR (hair growth associated), ATR (ATR serine/threonine kinase), HTRA1 (HtrA serine peptidase 1), AIRE (autoimmune regulator), BCS1L (BC1 (ubiquinol-cytochrome c reductase) synthesis-like), MCCC2 (methylcrotonoyl-CoA carboxylase 2 (beta)), DKC1 (dyskeratosis congenital 1, dyskerin), PORCN (porcupine homolog), EBP (emopamil binding protein (sterol isomerase)), SLITRK1 (SLIT and NTRK-like family, member 1), BTK (Bruton agammaglobulinemia tyrosine kinase), DOCK6 (dedicator of cytokinesis 6), APCDD1 (adenomatosis polyposis *coli* down-regulated 1), ZIP4 (zinc transporter 4 precursor), CASR (calcium-sensing receptor), TERT (telomerase reverse transcriptase), EDARADD (EDAR (ectodysplasin-A receptor)-associated death domain), ATP6VOA2 (ATPase, H+transporting, lysosomal V0 subunit a2), PVRL1 (poliovirus receptor-related 1 (herpesvirus entry mediator C)), MGP (matrix Gla protein), KRT85 (keratin 85, type II), RAG2 (recombination activating gene 2), RAG-1 (recombination activating gene 1), ROR2 (receptor tyrosine kinase-like orphan receptor 2), CLAUDIN1 (claudin 7), ABCA12 (ATP-binding cassette, subfamily A (ABC1), member 12), SLA-DRA1 (MHC class II DR-alpha), B4GALT7 (xylosylprotein beta 1,4-galactosyltransferase, polypeptide 7), COL7A1 (collagen type VII, alpha 1), NHP2 (NHP2 ribonucleoprotein), GNA11 (guanine nucleotide binding protein (g protein), alpha 11 (Gq class)), WNT5A (wingless-typ MMTV integration site family member 5A), USB1 (U6 snRNA biogenesis 1), LMNA (lamin A/C), EPS8L3 (EPS8-like 3), NSDHL (NAD(P) dependent steroid dehydrogenase-like), TRPV3 (transient receptor potential cation channel subfamily V, member 3), KRAS (Kirsten rat sarcoma viral oncogene homolog), TINF2 (TERF1-interacting nuclear factor 2), TGM1 (tranglutaminase 1), DCLRE1C (DNA cross-link repair 1C), PKP1 (plakophilin 1), WRAP53 (WD repeat containing antisense to TP53), KDM5C (lysine (k) specific demethylase 5C), ECM1 (extracellular matrix protein 1), TP63 (tumor protein p63), KRT14 (keratin 14), RIPK4 (receptor-interacting serine-threonine kinase 4), PRKDC (protein kinase, DNA activated, catalytic polypeptide), BCL11a (B-cell CLL/lymphoma 11A (zinc finger protein)), BMI (BMI1 proto-oncogene, polycomb ring finger), CCR5 (chemokine (C-C motif) receptor 5 (gene/pseudogene)), CXCR4 (chemokine (C-X-C motif) receptor 4), DKK1 (dickkopf WNT signaling pathway inhibitor 1), ETV2 (ets variant 2), FLI1 (Fli-1 proto-oncogene, ETS transcription factor), FLK1 (kinase insert domain receptor), GATA2 (GATA binding protein 2), GATA4 (GATA binding protein 4), MYF5 (myogenic factor 5), MYOD1 (myogenic differentiation 1), MYOG (myogenin), NKX2-5 (NK2 homeobox 5), NR4A2 (nuclear receptor subfamily 4, group A, member 2), PAX3 (paired box 3), PITX3 (paired-like homeodomain transcription factor 3), Runx1 (runt-related transcription factor 1), RAG2 (recombination activating gene 2), GGTA (bifunctional cephalosporin acylase/gamma-glutamyhtranspeptidase), HANDII (heart- and neural crest derivative expressed protein 2), TBX5 (T-box 5), ETV2 (ets variant 2), TBX4 (T-box 4), ID2 (inhibitor of DNA binding 2), SOX2 (SRY (sex determining region Y)-box 2), TTF1/NKX2-1 (NK2 homeobox 1), MESP1 (mesoderm posterior 1), NKX2-5 (HK2 homeobox 5), FAH (fumarylacetoacetate hydrolase), SALL1, PRKDC (protein kinase, DNA activated, catalytic polypeptide), RUNX1 (runt related transcription factor 1), FLI1 (fli-1 proto-oncogene, ETS transcription factor), PITX3 (paired-like homeodomain transcription factor 3, DKK1 (dickkopf WNT signaling pathway inhibitor 1), FLK1 (kinase insert domain receptor), BCL11A (B-cell CLL/lymphoma 11A (zinc finger protein), RAG2 (recombination activating gene 2), RAG1 (recombination activating gene 1), IL2RG (interleukin 2 receptor, gamma chain), c-KIT/SCFR (v-kit hardy-Zuckerman 4 feline sarcoma viral oncogene homolog), BMI1 (BMI1 proto-oncogene polycomb ring finger), TBX5 (T-box 5) and/or combinations thereof are disrupted in said non-human embryo. (Disrupted throughout this application means knocked out or knocked down; such as there is reduced or no expression of said genes, mRNAs or proteins they code for.) In one embodiment, ETV2 is disrupted. In another embodiment, ETV2 and NKX2-5 and HandII are disrupted. In another embodiment, NKX2-5 and TBX5 are disrupted. In one embodiment, HandII and TBX5 are disrupted. In another embodiment, NKX2-5 and HandII and TBX5 are disrupted. In another embodiment, ETV2 and NKX2-5 are disrupted. In one embodiment, ETV2 and NKX2-5 and HandII OR NKX2-5 and TBX5 OR HandII and TBX5 OR NKX2-5 and HandII and TBX5 are disrupted. In another embodiment, MYF5, MYOD, MRF4 and ETV2 or any combination thereof are disrupted. In one embodiment, expression of BLC2 and/or TP53 is under control of an OCT4 promoter.

| Accession Number List | | |
|---|---|---|
| Gene name | Species | Accession Number |
| ABCA12 (ATP-binding cassette, subfamily A (ABC1), member 12) | human | NG_007074 |
| | pig | XM_021074975 |
| ABCG2 (ATP-binding cassette sub-family G member 2) | human | NG_032067 |
| | pig | NM_214010 |
| ABHD5 (abhydrolase domain containing 5) | human | NG_007090 |
| | pig | NM_001012407 |
| ACAN (aggrecan) | human | NG_012794 |
| | pig | NM_001164652.1 |
| ACVR1 (activin A receptor, type I) | human | NG_008004 |
| | pig | HQ180176.1 |
| AIRE (autoimmune regulator) | human | NG_009556 |
| | pig | XM_021069857 |
| ALMS1 (Alstrom syndrome protein 1) | human | NG_011690 |
| | pig | XR_002342571.1 |
| ALOX12B (arachidonate 12lipoxygenase 12R type) | human | NG_007099 |
| | pig | XM_021067856 |
| AMELY (amelogenin, y-linked) | human | NG_008011 |
| | pig | NM_213800 |
| ANTRX1 (anthrax toxin receptor 1) | human | NR_103827.1 | ANTXRLP1 shown |
| | pig | XM_003125066 |
| APC (adenomatosis polyposis *coli*) | human | NG_008481 |
| | pig | NM_001206430 |
| APCDD1 (adenomatosis polyposis *coli* down-regulated 1) | human | NG_027685 |
| | pig | XM_021096050 |
| ApoE (apolipoprotein E) | human | NG_007084 |
| | pig | NM_214308 |
| ARHGAP31 (Rho GTPase activating protein 31) | human | NG_007665 |
| | pig | XM_21070330.1 |
| ATP6V0A2 (ATPase, H+ transporting, lysosomal V0 subunit a2) | human | NG_012743 |
| | pig | XM_013982778.2 |

-continued

Accession Number List

| Gene name | Species | Accession Number | |
|---|---|---|---|
| ATR (ATR serine/ | human | NG_008951 | |
| threonine kinase) | pig | XM_021069571 | |
| B3GALT6 (UDP-Gal:betaGA1 | human | NG_033265.1 | |
| beta 1,3 galactosyltransferase polypeptide 6) | pig | XM_003127488 | |
| B4GALT7 (xylosylprotein beta | human | NG_015977 | |
| 1,4-galactosyltransferase, polypeptide 7) | pig | NM_001168422 | |
| BCL11a (B-cell CLL/lymphoma | human | NG_011968 | |
| 11A (zinc finger protein)) | pig | NM_001297634.1 | |
| BCS1L (BC1 (ubiquinol-cytochrome | human | NG_033099.1 | |
| c reductase) synthesis-like) | pig | NM_001243676.1 | |
| BLG (progestagen-associated | human | NM_002571.4 | |
| endometrial protein) | pig | NM_213754 | |
| BMI1 (BMI1 proto-oncogene, | human | NM_005180 | |
| polycomb ring finger) | pig | NM_001285971.1 | |
| BMP1B (FecB) (bone morphogenetic | human | NG_009245 | |
| protein receptor, type 1B) | pig | NM_001039745.1 | |
| BTK (Bruton agammaglobulinemia | human | NG_009616 | |
| tyrosine kinase) | pig | NM_001243576 | |
| CCR5 (chemokine (C-C motif) | human | NG_012637 | |
| receptor 5 (gene/pseudogene)) | pig | NM_001001618.1 | |
| CERS3 | human | NG_042826 | |
| (ceramide synthase 3) | pig | XM_005659788.2 | |
| c-KIT/SCFR (v-kit hardy- | human | BC071593.1 | |
| Zuckerman 4 feline sarcoma | pig | | no variant with |
| viral oncogene homolog) | | | feline sarcoma virus |
| CLAUDIN1 | human | NM_001307.6 | |
| (claudin 7) | pig | NM_001160076.1 | |
| COL3A1 (collagen, | human | NG_007404 | |
| type III, alpha 1) | pig | NM_001243297 | |
| COL7A1 (collagen | human | NG_007065 | |
| type VII, alpha 1) | pig | XM_005669519.3 | |
| CTC1 (CTS telomere | human | NG_032148 | |
| maintenance complex component 1) | pig | XM_003358277 | |
| CWC15 (CWC15 spliceosome | human | NP_057487.2 | |
| associated protein) | pig | XM_003129753.4 | |
| CXCR4 (chemokine (C-X-C motif) | human | NG_011587 | |
| receptor 4) | pig | NM_213773 | |
| DAZL (deleted in | human | NG_023329 | |
| azoospermia like) | pig | XM_003358321 | |
| DCAF17 (DDB1 and CUL4 | human | NG_013038 | |
| associated factor 17) | pig | XM_001928016.5 | |
| DCLRE1C (DNA cross-link repair 1C) | human | NG_007276 | |
| | pig | NM_001258445.1 | |
| DGAT (diglyceride acyltransferase) | human | NG_034192 | |
| | pig | NM_214051.1 | |
| DKC1 (dyskeratosis congenital 1, | human | NG_009780 | |
| dyskerin) | pig | NM_001142668 | |
| DKK1 (dickkopf WNT signaling | human | NM_012242 | |
| pathway inhibitor 1) | pig | NM_001145384 | |
| DMD (dystrophin muscular dystrophy) | human | NG_012232 | |
| | pig | NM_001012408.1 | |
| DNA activated, catalytic polypeptide) | human | NG_023435 | |
| | pig | XM_021089420.1 | |
| DOCK6 (dedicator of cytokinesis 6) | human | NG_031953 | |
| | pig | XM_021083862.1 | |
| DSG4 (desmoglein 4) | human | NG_013040 | |
| | pig | XM_003356395 | |
| EBP (emopamil binding protein | human | NG_007452 | |
| (sterol isomerase)) | pig | NM_001167646.1 | |
| ECM1 (extracellular matrix protein 1) | human | NG_012062 | |
| | pig | XM_021089906.1 | |
| EDAR (ectodysplasin-A receptor) | human | NG_008257 | |
| | pig | XM_013995872.2 | |
| EDARADD (EDAR (ectodysplasin- | human | NG_011566 | |
| A receptor)-associated death domain) | pig | NM_001243663.1 | |
| Eif4GI (eukaryotic translation | human | NG_016850 | |
| initiation factor 4 gamma, 1) | pig | NM_001246253.1 | |
| EOGT (EGF domain-specific 0- | human | NG_042829 | |
| linked N-acetylglucosamine (GlcNAc)) | pig | NM_001315674.1 | |
| ETS transcription factor) | human | | many variants, like ETV2, shown but no ETS alone |
| | pig | | |

-continued

Accession Number List

| Gene name | Species | Accession Number |
|---|---|---|
| ETV2 (ets variant 2), FLI1 (Fli-1 proto-oncogene | human | NM_014209.4 |
| | pig | XM_021097205 |
| FAH (fumarylacetoacetate hydrolase) | human | NG_012833 |
| | pig | XM_003356648 |
| FLI1(fli-1 proto-oncogene, ETS transcription factor) | human | NG_032912 |
| | pig | XM_021063122.1 |
| FLK1 (kinase insert domain receptor) | human | NG_012004 |
| | pig | XM_003128987.6 |
| GATA2 (GATA binding protein 2) | human | NG_029334 |
| | pig | NM_213879.1 |
| GATA4 (GATA binding protein 4) | human | NG_008177 |
| | pig | NM_214293.1 |
| GDF8 (growth/differentiation factor 8) | human | NG_009800 |
| | pig | NM_214435 |
| GGTA (bifunctional cephalosporin acylase/gamma-glutamyltranspetidase) | human | |
| | pig | |
| GHRHR (growth hormone releasing hormone receptor) | human | NG_021416 |
| | pig | NM_214035.2 |
| GNA11 (guanine nucleotide binding protein (g protein), alpha 11 (Gq class)) | human | NG_033852 |
| | pig | NM_001044538 |
| HANDII (heart-and neural crest derivative expressed protein 2) | human | NG_046954 |
| | pig | XM_013982698 |
| HBB (hemoglobin beta) | human | NG_059281.1 |
| | pig | NM_001144841 |
| HLCS (holocarboxylase synthetase (biotin-(proprionyl-CoA-carboxylase)ATP-hydrolysing)) ligase)) | human | NG_016193 |
| | pig | XM_013982582.2 |
| Horn-poll locus | human | |
| | pig | |
| HR (hair growth associated) | human | NG_008166 |
| | pig | NM_001083930 |
| HRAS (Harvey rat sarcoma viral oncogene homolog) | human | NG_007666 |
| | pig | XM_021082554.1 |
| HSD11B2 (hydroxysteroid (11-beta) dehydrogenase 2) | human | NG_016549 |
| | pig | NM_213913 |
| HTRA1 (HtrA serine peptidase 1 | human | NG_011554 |
| | pig | XM_003133208 |
| IGF2 (insulin-like growth factor 2) | human | NG_050578.1 |
| | pig | NM_213883.2 |
| IKBKG (inhibitor of kappa light polypeptide gene enhancer in B-cells, kinase gamma) | human | NG_009896 |
| | pig | NM_001113053.1 |
| IL2RG (interleukin 2 receptor, gamma chain) | human | NG_021141.1 |
| | pig | NM_214083.2 |
| IL2RG2 (interleukin 2 receptor, gamma chain 2) | human | NG_009088.1 |
| | pig | NM_214083.2 |
| KDM5C (lysine (k) specific demethylase 5C) | human | NG_08085 |
| | pig | NM_001097433.1 |
| KissR/GRP54 (kisspeptin) | human | NG_032151 |
| | pig | NM_001134964.1 |
| KRAS (Kirsten rat sarcoma viral oncogene homolog) | human | NG_007524 |
| | pig | XM_003126427.5 |
| KRT14 (keratin 14) | human | NG_008624 |
| | pig | XM_003482984 |
| KRT85 (keratin 85, type II) | human | NG_008353 |
| | pig | XM_003126159 |
| LAMA3 (laminin, alpha 3) | human | NG_007853 |
| | pig | XM_003482042.4 |
| LAMB3 (laminin, beta 3) | human | NG_007116 |
| | pig | XM_021063882 |
| LDLR (low density lipoprotein receptor) | human | NG_009060 |
| | pig | NM_001206354.2 |
| LMNA (lamin A/C), EPS8L3 (EPS8-like 3) | human | NG_008692 |
| | pig | NM_001111257.2 |
| LPAR6 (lysophosphatidic acid receptor 6) | human | NG_012874.1 |
| | pig | XM_003482887 |
| MBTPS2 (membrane-bound transcription factor peptidase, site 2) | human | NG_012797 |
| | pig | XM_021079698.1 |
| MCCC2 (methylcrotonoyl-CoA carboxylase 2 (beta)) | human | NG_008882 |
| | pig | XM_005672531 |
| MESP1 (mesoderm posterior 1) | human | NM_018670.3 |
| | pig | XM_001925990.6 |
| MGP (matrix Gla protein) | human | NG_023331 |
| | pig | NM_214116 |
| MIWI (piwi-like RNA-mediated gene silencing 1) | human | NM_004764.4 |
| | pig | NM_001194973.1 |
| MODY1 (HNF4α) (hepatocyte | human | NG_009818 |

Accession Number List

| Gene name | Species | Accession Number |
|---|---|---|
| nuclear factor 4, alpha) | pig | NM_001044571.1 |
| MODY10 (INS) | human | NG_050578.1 |
| (insulin) | pig | NM_001109772.1 |
| MODY11 (BLK) (BLK proto-oncogene, Src family tyrosine kinase) | human | NG_023543 |
| | pig | XM_003359055.4 |
| MODY2 (GCK) | human | NG_008847 |
| (glucokinase) | pig | XM_003134883.2 |
| MODY3 (HNF1α) | human | NG_011731 |
| (hepatocyte nuclear factor 4, alpha) | pig | NM_001032388 |
| MODY4 | human | NG_008183 |
| | pig | NM_001141984 |
| MODY5 (HNF-1β) | human | NG_013019 |
| (HNF1 homeobox B) | pig | NM_213956.1 |
| MODY6 (eurogenic differentiation 1) | human | NG_011820 |
| | pig | XM_021075510 |
| MODY7 (KLF11) (Kruppel-like factor 11) | human | NG_017199 |
| | pig | NM_001134346 |
| MODY8 (CEL) (carboxyl ester lipase) | human | NG_016394 |
| | pig | XM_003353694 |
| MODY9 (PAX4) | human | NG_012848 |
| (paired box 4) | pig | XM_021078737 |
| MYF5 (myogenic factor 5) | human | NM_005593 |
| | pig | NM_001278775 |
| MYOD1 (myogenic differentiation 1) | human | NM_002478 |
| | pig | NM_001002824 |
| MYOG | human | NM_002479 |
| (myogenin) | pig | NM_001012406 |
| NF1 | human | NG_009018 |
| (neurofibromin 1) | pig | XM_021067460 |
| NHP2 (NHP2 ribonucleoprotein) | human | NG_011765 |
| | pig | XM_003123671 |
| NIPAL4 (NIPA-like domain containing 4) | human | NG_016626 |
| | pig | XM_003134113 |
| NKX2-5 (HK2 homeobox 5) | human | NG_013340 |
| | pig | XM_003134041 |
| NOP10 (NOP10 ribonucleoprotein) | human | NG_011562 |
| | pig | XM_001925450 |
| NPPA | human | NG_012926 |
| (natriuretic peptide A) | pig | NM_214260.2 |
| NR3C2 (nuclear receptor subfamily 3, group C, member 2) | human | NG_013350 |
| | pig | XM_013978839.2 |
| NR4A2 (nuclear receptor subfamily 4, group A, member 2) | human | NG_011821 |
| | pig | NM_001190276.1 |
| NSDHL (NAD(P) dependent steroid dehydrogenase-like) | human | NG_009163 |
| | pig | NM_001167636.1 |
| OFD1 (oral-facial-digital syndrome 1) | human | NG_008872 |
| | pig | XM_003134936.4 |
| OFD1Y (Y-linked oral-facial-digital syndrome 1 pseudogene) | human | NG_004636 |
| | pig | |
| p53 (cellular tumor antigen p53-like) | human | NG_017013 |
| | pig | NM_213824 |
| p65 (v-rel reticuloendotheliosis viral oncogene homolog A) | human | S82307.1 |
| | pig | KC316023.1 |
| PAX3 (paired box 3) | human | NG_011632 |
| | pig | XM_021075358.1 |
| PEX7 (peroxisomal biogenesis factor 7) | human | NG_008462 |
| | pig | XM_021087521.1 |
| PITX3 (paired-like homeodomain transcription factor 3) | human | NG_008147 |
| | pig | XM_021073065 |
| PIWI (CG6122 gene product from transcript CG6122-RA) | human | NM_004764.4 |
| | pig | NM_001194973.1 |
| PKD1 (polycystic kidney disease 1) | human | NG_008617 |
| | pig | NM_001246202.1 |
| PKP1 | human | NG_023337 |
| (plakophilin 1) | pig | XM_021064508 |
| PNPLA1 (patatin-like phospholipase domain containing 1) | human | NG_032813 |
| | pig | XM_021100036 |
| PORCN | human | NG_009278 |
| (porcupine homolog) | pig | XM_003360298.4 |
| PRKDC | human | NG_023435 |
| (protein kinase) | pig | XM_021089420.1 |
| PRLR | human | NG_029042 |
| (prolactin receptor) | pig | NM_001001868 |
| PRDM14 (PR domain containing 14) | human | NM_24504.3 |
| | pig | XM_021090784 |

Accession Number List

| Gene name | Species | Accession Number |
| --- | --- | --- |
| PRNP (prion protein) | human | NG_009087 |
| | pig | NM_01008687.1 |
| PVRL1 (poliovirus receptor-related 1 (herpesvirus entry mediator C)) | human | |
| | pig | |
| RAG1 (recombination activating gene 1) | human | NG_007528 |
| | pig | NM_001123184.1 |
| RAG2 (recombination activating gene 2) | human | NG_033154.1 |
| | pig | NM_001128481.1 |
| Rbm20 (RNA binding motif protein 20) | human | NG_021177 |
| | pig | XM_021073215 |
| RBPJ (recombination signal binding protein for immunoglobulin kappa J region) | human | NG_030343 |
| | pig | XM_003128890.6 |
| RIPK4 (receptor-interacting serine-threonine kinase 4) | human | NG_032113 |
| | pig | XM_003132781 |
| ROR2 (receptor tyrosine kinase-like orphan receptor 2) | human | NG_008089 |
| | pig | XM_013990242.2 |
| Rosa, Socs2(suppressor of cytokine signaling 2) | human | NM_001270471.2 |
| | pig | NM_001097461.1 |
| RPL21 (ribosomal protein) | human | NG_046927 |
| | pig | XM_003482864.4 |
| RUNX1 (runt related transcription factor 1) | human | NG_011402 |
| | pig | NM_001246252.1 |
| SALL1 | human | NG_007990 |
| | pig | XM_003126987 |
| SAT1 (spermindine/spermine N1-acetyltransferase 1) | human | NG_012929 |
| | pig | NM_214358 |
| SCNN1G (sodium channel, non-voltage gated 1 gamma subunit) | human | NG_011909 |
| | pig | XM_003124543 |
| SLA-DRA1 (MHC class II DR-alpha) | human | AM910169.1 |
| | pig | MF498819.1 |
| SLITRK1 (SLIT and NTRK-like family, member 1) | human | NG_016748 |
| | pig | NM_001308829 |
| SNRPE (small nuclear ribonucleoprotein polypeptide E) | human | NG_050954 |
| | pig | DQ629140.1 |
| SOX2 (SRY (sex determining region Y)-box 2) | human | NG_009080 |
| | pig | NM_001123197 |
| SRY (sex determining region of Chr Y) | human | NG_11751 |
| | pig | NM_214452 |
| TBX4 (T-box 4), ID2 (inhibitor of DNA binding 2) | human | NG_008080 |
| | pig | NM_001246249 |
| TBX5 (T-box 5), ETV2 (ets variant 2) | human | | nothing found with ETV2 and TBX 5 |
| | pig | | |
| TBX5 (T-box 5) | human | NG_007373 |
| | pig | XM_013982910.2 |
| Telomerase-vert, DSP (desmoplakin) | human | NG_008803 |
| | pig | XM_003128168.4 |
| TERT (telomerase reverse transcriptase) | human | NG_009265 |
| | pig | NM_001244300 |
| TGM1 (tranglutaminase 1) | human | NG_007150 |
| | pig | XM_021099206 |
| TINF2 (TERF1-interacting nuclear factor 2) | human | NG_016650 |
| | pig | XM_001927925.5 |
| tP53 (tumor protein p53) | human | NG_017013 |
| | pig | NM_213824 |
| TP63 (tumor protein p63) | human | NG_007550 |
| | pig | XM_013982288.2 |
| TRPV3 (transient receptor potential cation channel subfamily V, member 3) | human | NG_032144 |
| | pig | XM_005669116.3 |
| TTF1/NKX2-1 (NK2 homeobox 1) | human | NG_013365 |
| | pig | NM_001311186.1 |
| UBR1 (ubiquitin protein ligase E3 component n-recognin 1) | human | NG_012182 |
| | pig | XM_021097089.1 |
| UROD (uroporphyrinogen decarboxylase) | human | NG_007122.2 |
| | pig | NM_001244940 |
| UROS (uroporphyrinogen III synthase) | human | NG_011557 |
| | pig | NM_001244365.1 |
| USB1 (U6 snRNA biogenesis 1) | human | NG_027698 |
| | pig | NM_001244803 |
| VASA (vasa protein) | human | NM_024415.2 |
| | pig | NM_001291682.1 |
| VDR (vitamin D receptor) | human | NG_008731 |
| | pig | NM_001097414.1 |

-continued

Accession Number List

| Gene name | Species | Accession Number |
|---|---|---|
| WNT5A (wingless-typ MMTV integration site family member 5A) | human | NG_031992 |
| | pig | XM_005669658.3 |
| WRAP53 (WD repeat containing antisense to TP53 | human | NG_028245 |
| | pig | XM_003131944 |
| ZFY (zinc finger protein, y-linked) | human | NG_008113 |
| | pig | AH011262.2 |
| ZIP4 (zinc transporter 4 precursor), | human | NG_012234 |
| CASR (calcium-sensing receptor) | pig | XM_001925360.5 |
| β-lactoglobulin, | human | |
| callipyg (CLPG) | pig | |

One embodiment provides a method to increase the efficiency of human:non-human animal chimera generation comprising introducing one or more human cells into a non-human embryo, wherein the one or more human cells overexpress BCL2 and has reduced expression of TP53; wherein the increased expression of BCL2 and reduced expression of TP53 results in the increased efficiency of chimera generation as compared to generating a human:non-human animal chimera with one or more human cells with wild-type expression of BCL2 and TP53.

Another embodiment provides a method to increase the efficiency of human:non-human animal chimera generation comprising introducing one or more human cells into a non-human embryo, wherein the one or more human cells has reduced expression of TP53; wherein the reduced expression of TP53 results in the increased efficiency of chimera generation as compared to generating a human:non-human animal chimera with one or more human cells with wild-type expression of TP53.

One embodiment provides a chimeric embryo comprising a non-human embryo and one or more cells derived from one or more human cells, wherein the human cells overexpress BCL2 and have reduced expression of TP53 as compared to wild-type human cells.

One embodiment provides for an animal that has developed from the chimeric embryo disclosed herein. Another embodiment provides for human or humanized tissue or organ harvested from an animal that has developed from the chimeric embryo disclosed herein.

BRIEF DESCRIPTION OF THE DRAWINGS

FIGS. 9A-D. CRISPR/Cas9 gene editing to product triple knockout porcine embryos. Panels A, B and C represent the schematic genomic loci of the pig NKX2-5, HAND2 and TBX5 genes, respectively. The shaded rectangles represent the coding exons. The red arrows represent the gRNA targets and the black arrows represent the PCR screening forward and reverse primers. Each gene was targeted with two gRNAs to create a small deletion after the start codon. D represents the PCR product expected from the wild-type (WT) and mutant gene locus from each of the genes. E shows the PCR genotyping of the cardiac knock out (KO) clone showing the biallelic small deletions compared to the wild type (WT) cells.

FIG. 10. Triple mutant pig embryo that lacks NKX2-5, HANDII, and TBX5 result in acardia. The three genes were simultaneously mutated using multiplex gene editing in the porcine embyro. Comparison with an age-matched wildtype embryo reveals absence of the GATA4 positive heart primordium.

FIGS. 11A-E. Formation of pig-pig embryonic chimeras in vitro. A). Schematic showing the steps involved during the pig-pig chimera experiment. B) Representative brightfield (left) and green fluorescence (right) images of GFP-labeled blastomeres injected into pig parthenotes at 6, 8 and 10 days of development. C) Quantitative analysis of the GFP+ parthenotes at various time periods. Quantification involved data from 3 independent experiments (40 parthenotes were analyzed at each time point). (D) Quantitative analysis of GFP+ cells per parthenote at the indicated time points. Quantification of data from three independent experiments. (E) Immunohistochemical analysis revealed that the GFP+ blastomeres integrated and contributed to both Oct4+/CDX2+ (open arrowheads; trophectoderm) and Oct4+/CDX2− (filled arrowheads; inner cell mass) populations.

FIGS. 12A-O. Pig-Pig blastocyst complementation rescues entire lineages. The pig-pig complementation of the ETV2 null embryo with wildtype GFP-labeled pig blastomeres rescues the lethality and the absence of vascular and blood lineages. A) Whole mount image of the pig-pig complemented ETV2 null embryo at E18 showing normal structures and the presence of blood (red). B) Darkfield fluorescence of the pig-pig complemented embryo in panel A showing GFP-labeled vascular and blood cells at low magnification (B) and at high magnification (C). D-F) Histological sections revealing that every Tie2 labeled endothelial cell is also labeled with GFP verifying that the vasculature of the ETV2 null embryo is completely rescued by the GFP-labeled wildtype pig blastomeres. I) Quantification of the pig-pig complemented embryo compared to control dilutions. J-L) Immunofluorescence histological sections of the complemented pig-pig embryo reveals wildtype GFP-labeled blastomeres also contributed to smooth muscle (J-L), neural tube (M) and intestine (N) in the chimeric porcine embryo. O) Quantification of the chimerism demonstrates that 100% of the vasculature and the blood are contributed by the wildtype GFP-labeled blastomeres (and their derivatives) and other tissues with less than 40% chimerism.

FIGS. 13A-C. Engineering new hiPSC lines for interspecies chimerism studies. a) Brightfield image of human embryonic fibroblasts. b) Brightfield image of naïve human induced pluripotent stem cell (iPSC) colonies derived from fibroblasts described in panel (a) after 30 days of OSKM induction. c) GFP positive hiPSC colonies following H2B-EGFP knock-in to the AAVS1 locus (Scale bars 100 μm).

FIGS. 14A-C. Engineering human-porcine chimeric embryos in vitro. A) Image showing single cell suspension of nuclear GFP-labeled hiPSCs. B) Brightfield image of the cell delivery process (hiPSCs) into the E4 pig morula. C) Green fluorescence image of the GFP-labeled hiPSCs in the capillary tube showing that two cells were injected into each parthenote.

FIGS. 15A-D. Calcein transfer from injected hiPSCs to pig blastomeres through gap junctions, 24 hrs after injection. (A) The injected parthenotes using brightfield microscopy. (B) The injected cells loaded with Calcein (green). (C) The injected cells labeled with DiI. (D) Calcein transfer from the injected hiPSCs to the pig blastomeres. Scale bars, 20 μm.

FIG. 16. Calcein AM injection into the parthenotes. Calcein AM with ½ or ¼ of the concentration of the loaded hiPSCs was injected into the parthenote blastocele. Note that no Calcein was observed in the blastomeres. Scale bars, 20 μm.

DETAILED DESCRIPTION OF THE INVENTION

Figure 1:
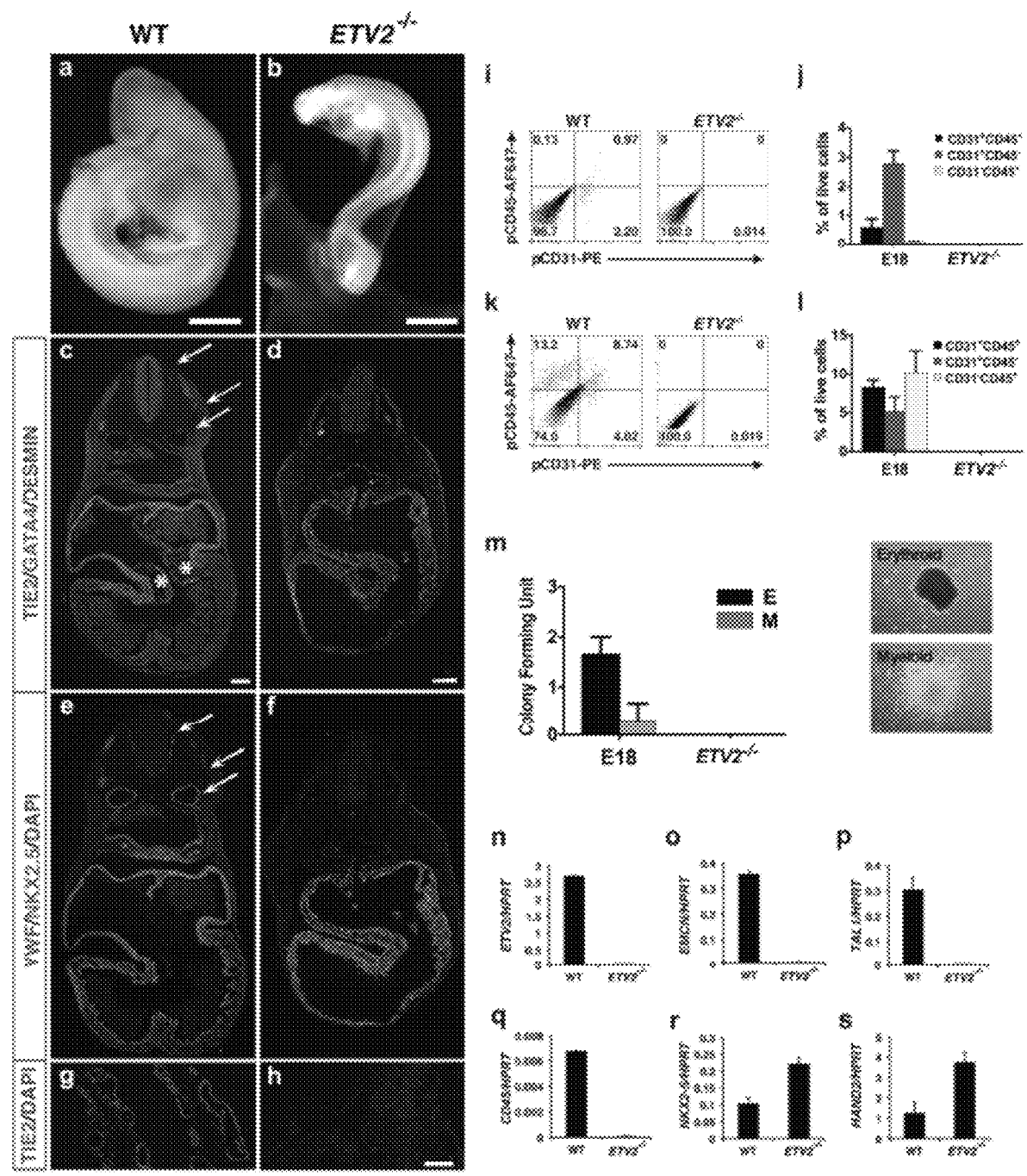
FIGS. 1A-S. Porcine EV2 knockout embryos lack the hematopoietic and endothelial lineages and recapitulate the mouse phenotype. (a-h) Wholemount view (a, b) and cross sections (c-h) of wildtype (a, c, e, g) and E7V2 knockout (b, d, f, h) embryos at E18. A total of 898 embryos were transferred to pseudopregnant gilts and 24 ETV2 null embryos were obtained from three independent ETV2 null porcine fibroblast clones and analyzed by wholemount imaging. Seven of these E18 E7V2 null embryos were examined immunohistochemically. Sections were stained with antibodies to TIE2 (c,d,g,h) and VWF (e,f) to label the hematoendothelial lineages, and GATA4/DESMIN (c,d) and NKX2-5/SMA (e,f) to label the cardiac lineages. g and h are yolk sac sections. Arrows point to the endothelial cells. Asterisk denotes the cardiac cushion. Scale bars, 1 mm (a, b), 100 μm (c-h). (i-l) FACS analysis of blood lineage from dissociated embryos (n=3 for WT and n=5 for ETV2$^{-/-}$). Representative plots (i, k) and quantification from WT and ETV2$^{-/-}$ embryos (j, l) are shown. (m) Methylcellulose colony forming assay reveals the complete absence of hematopoietic units in ETV2 knockout embryos (n=3 for WT and n=5 for ETV2$^{-/-}$). (n-s) Quantification of ETV2 (n), EMCN (o), TAL1 (p), CD45 (q), NKX2-5 (r), and HAND2 (s) transcripts using qPCR analysis (three WT and five E7V2 null embryos were used for the qPCR analysis and the data shown are in triplicate for each embryo). Error bars indicate ±SEM.

Although previous studies support engineering exogenous organs in animals by using human pluripotent stem cells, the efficiency of this chimerism makes the engineering of chimeric animals expensive and challenging. Additionally, the potential for retention of host-derived endothelium, capable of eliciting a hyperacute rejection following transplantation (1, 2), is not desirable.

Definitions

In describing and claiming the invention, the following terminology will be used in accordance with the definitions set forth below. Unless defined otherwise, all technical and scientific terms used herein have the same meaning as commonly understood by one of ordinary skill in the art to which this invention belongs. Any methods and materials similar or equivalent to those described herein can be used in the practice or testing of the present invention. Specific and preferred values listed below for radicals, substituents, and ranges are for illustration only; they do not exclude other defined values or other values within defined ranges for the radicals and substituents.

As used herein, the articles "a" and "an" refer to one or to more than one, i.e., to at least one, of the grammatical object of the article. By way of example, "an element" means one element or more than one element.

The term "about," as used herein, means approximately, in the region of, roughly, or around. When the term "about" is used in conjunction with a numerical range, it modifies that range by extending the boundaries above and below the numerical values set forth. In general, the term "about" is used herein to modify a numerical value above and below the stated value by a variance of 20%.

The term "isolated" refers to a factor(s), cell or cells which are not associated with one or more factors, cells or one or more cellular components that are associated with the factor(s), cell or cells in vivo.

"Cells" include cells from, or the "subject" is, a vertebrate, such as a mammal, including a human. Mammals include, but are not limited to, humans, farm animals, sport animals and companion animals. Included in the term "animal" is dog, cat, fish, gerbil, guinea pig, hamster, horse, rabbit, swine, mouse, monkey (e.g., ape, gorilla, chimpanzee, or orangutan), rat, sheep, goat, cow and bird.

The terms "pig" and "swine" and "porcine" are used interchangeably are generic terms referring to the same type of animal without regards to gender, size or breed.

Genetic engineering, including gene editing, can be carried out by any method available to an art worker, for example, by the use of targeted endonucleases, and homology directed repair (HDR), TALEN, CRISPR (e.g., CAS9/

CRISPR), recombinase fusion molecules, synthetic porcine artificial chromosomes, meganucleases, zinc finger or rAAV based systems for gene editing (e.g., to knockout desired target genes). Further, a variety of nucleic acids can be introduced into cells, for knockout purposes, for inactivation of a gene (such as interfering RNAs (shRNA, siRNA, dsRNA, RISC, miRNA) or express a gene.

Somatic cell nuclear transfer (SCNT) is a laboratory technique for creating a viable embryo from a body cell and an egg cell. The process of somatic cell nuclear transplant involves two different cells. The first being a female gamete, known as the ovum (egg/oocyte). The second being a somatic cell, referring to the cells of the human body. Skin cells, fat cells, and liver cells are only a few examples. The nucleus of the donor egg cell is removed and discarded, leaving it 'deprogrammed.' The nucleus of the somatic cell is also removed but is kept, the enucleated somatic cell is discarded. What is left is a lone somatic nucleus and an enucleated egg cell. These are then fused by squirting the somatic nucleus into the 'empty' ovum. After being inserted into the egg, the somatic cell nucleus is reprogrammed by its host egg cell. The ovum, now containing the somatic cell's nucleus, is stimulated with a shock and will begin to divide. The egg is now viable and capable of producing an adult organism containing all the necessary genetic information from just one parent. Development will ensue normally and after many mitotic divisions, this single cell forms a blastocyst (an early stage embryo with about 20-50 cells) with an identical genome to the original organism (i.e. a clone). Stem cells can then be obtained by the destruction of this clone embryo for use in therapeutic cloning or in the case of reproductive cloning the clone embryo is implanted into a host mother (pseudopregnant/surrogate) for further development and brought to term.

"Chimera" refers to a single organism composed of genetically distinct inter- and intra-species cells.

"Humanized" refers to an organ or tissue harvested from a non-human animal whose protein sequences and genetic complement are more similar to those of a human than the non-human host.

"Organ" refers to a collection of tissues joined in a structural unit to serve a common function. "Tissue" as used herein refers to a collection of similar cells from the same origin that together carry out a specific function.

A nullizygous organism carries two mutant or missing alleles for the same gene. The mutant/missing alleles are both complete loss-of-function or 'null' alleles, so homozygous null and nullizygous are synonymous.

A gene knockout (abbreviation: KO) is a genetic technique in which both of an organism's alleles are made inoperative ("knocked out" of the organism). The term knockout, inactivated, and disrupted are used interchangeably herein to mean that the targeted site is changed so that the gene expression product is eliminated or greatly reduced. Also known as knockout organisms or simply knockouts. The term also refers to the process of creating such an organism, as in "knocking out" a gene. The technique is essentially the opposite of a gene knockin. A gene knockdown refers to a gene that has been deactivated or suppressed rather than deleted. Gene silencing, gene editing, and conditional gene knockout are forms of gene knockdown.

The term 'gene' is broad and refers to chromosomal DNA that is expressed to make a functional product. Genes have alleles. Gene editing may be mono-allelic or bi-allelic.

The terms "comprises," "comprising," and the like can have the meaning ascribed to them in U.S. Patent Law and can mean "includes," "including" and the like. As used herein, "including" or "includes" or the like means including, without limitation.

The following examples are intended to further illustrate certain particularly preferred embodiments of the invention and are not intended to limit the scope of the invention in any way.

EXAMPLES

Example I

Introduction

Whole organ transplantation remains limited by the scarcity of donor organs. Xenotransplantation, using the pig as a donor, can provide an unlimited number of transplantable organs for patients having chronic end-stage diseases. One of the challenges associated with xenotransplantation, however, is organ rejection initiated by donor endothelial cells. Therefore, a novel strategy was pursued to generate pigs with humanized endothelial cells with the goal of providing a universal platform for exogenic organ production by reducing immunological rejection. Gene editing and somatic cell nuclear transfer (SCNT) technologies were used to engineer ETV2 mutant porcine embryos, which lacked endothelial and hematopoietic lineages and were embryonically lethal. To rescue these ETV2 porcine mutants, complementation experiments using GFP-labeled wildtype porcine blastomeres were used. These derived chimeric embryos were viable and all hematoendothelial lineages were populated by the donor-derived cells. Using embryo complementation strategies together with hiPSCs, survival and proliferation of the chimeric embryos in vitro and the engraftment of hiPSCs and BCL2 overexpressing hiPSCs into the ETV2 mutant embryos in vivo was demonstrated.

Materials and Methods

Animal assurance: The experimental studies were reviewed and approved by the Institutional Animal Care and Use Committee, and Stem Cell Research Oversight panels at the University of Minnesota and Midwest Research Swine.

Mice: Etv2-EYFP (4), Etv2 knockout (3), and Etv2 conditional knockout mice (9) have been described elsewhere. $Etv2^{dK1}$ was generated by deleting the conditional allele with a germline Cre-driver, EIIA-Cre (9).

ES/EB system: Etv2 null ES cell line and a control line derived from littermates have been reported previously (7). Mesodermal differentiation and FACS analysis were carried out as described (14).

Human induced pluripotent stem cells (hiPSCs): Sources of hiPSCs are: shiPSC9-1 (foreskin fibroblast, J. Dutton, Univ. of Minnesota), hBF-ACHE (fibroblasts, J. Hanna), human skin embryonic fibroblasts (8FW; GM00011 from Coriell Institute) and SC12-034 (mesenchymal stem cell, G. Daley, Harvard Medical School). These hiPSC lines tested negative for *mycoplasma* contamination. hiPSCS were cultured in mTeSR™1 or TeSR™-E8™ on Matrigel coated plastic plates as previously described (15), and passaged at least two days prior to usage, in a density to reach 70-80% confluency at the time of harvest. Cells were rinsed with PBS without calcium and magnesium, dissociated by TrypLE treatment for 5 min at 37° C. (ThermoFisher), suspended in a pre-warmed DMEM:F12 medium containing 15% serum and collected in a conical tube. Cells were collected by centrifugation for 5 min at 200 g and resuspended in mTeSR™1 containing ROCK inhibitor (10 μM Y27632). For in vitro tracing experiments, hiPSCs were pulsed with mTeSR™1 containing 10 μM EdU for 24 h or 5 μM DiI (Molecular Probes) for 2 h, washed in PBS, and dissociated prior to injection.

Genomic targeting of human iPS cells: RhiPSC11 cell line was dissociated to a single cell suspension using TrypLE Express (Gibco), centrifuged, resuspended and transfected according to the Human Stem Cell Nucleofector Kit 2 instructions (Lonza). CLYBL locus targeting using TALEN was done as previously described (Cerbini et al. 2015), pZT-C13-L1, pZT-C13-R1 and pC13N-iCAG.copGFP plasmids were purchased from Addgene (Addgene plasmids #62196, 62197 and 66578, respectively). Colonies were then selected using Neomycin at 50 μg/m. BCL2-puro donor plasmid was edited in house and knocked-in to the AAVS1 locus using CRISPR cas9 method using gRNA gtcaccaatcctgtccctag (SEQ ID NO: 1). Colonies were selected with 0.5 μg/ml Puromycin.

Guide RNA (gRNA) design and cloning: Candidate gRNA sequences for pig ETV2 were designed using the online tool "crispr.mit.edu/". 5' (cagcagacgtcacaatccgc; SEQ ID NO: 2)) and 3' (tggtaccgactagatcctcc; SEQ ID NO: 3) gRNAs flanking the ETV2 gene were designed and cloned into the mammalian-codon-optimized Cas9 expressing plasmid pX459 (Addgene #48139) as described elsewhere (16).

Fetal Fibroblast Collection, Tissue Culture and Nucleofection: Porcine fetal tissue was collected on Day 35 of gestation to create cell lines as described previously (10). Briefly, each fetus was minced and digested in 20 ml of digestion media (Dulbecco-modified Eagle's medium (DMEM) containing L-glutamine and 1 g/L D-glucose (Cellgro) supplemented with 200 units/ml collagenase (Sigma) and 25 Kunitz units/ml DNaseI (Sigma)) for 4 h at 38.5° C. Following digestion, fetal fibroblast cells were washed and cultured with DMEM containing 15% fetal bovine serum (FBS) and 40 μg/ml gentamicin. After overnight culture, the cells were trypsinized and frozen at −80° C. in aliquots in FBS with 10% dimethyl sulfoxide overnight and moved to liquid nitrogen for long term storage. Pig fibroblasts were maintained at 38.5° C. at 5% $CO_2$ in DMEM supplemented with 15% fetal bovine serum, 5 ng/ml basic fibroblast growth factor, and 10 mg/ml gentamicin. These cells were kept at a low passage (passage less than 10) and characterized based on their morphology. The Nucleofector 2b device (Lonza) was used to deliver the all-in-one CRISPR/Cas9 plasmid using program U-012. Approximately 600,000 cells were nucleofected with 6 μg of plasmid using the Basic Nucleofector™ Kit for Primary Mammalian Fibroblasts (#VPI-1002). Nucleofected cells were cultured for 2 or 3 days at 38.5° C., and then analyzed for gene editing efficiency and plated for colonies.

Dilution cloning: Two or three days post nucleofection, 50 cells were seeded onto 10 cm dishes and cultured for two weeks. Colonies were picked on Day 14 following transfection by applying 10 mm autoclaved cloning cylinders around each colony. Colonies were rinsed with PBS and harvested via trypsin treatment; then resuspended in DMEM culture medium. Two-thirds of the resuspended colony were transferred into a well of 24-well plate and the remaining one-third was collected into a PCR tube. The cell pellets were resuspended in 10 μl of lysis buffer (40 mM Tris, pH 8.9, 0.9% Triton X-100, 0.4 mg/ml proteinase K (NEB)), incubated at 65° C. for 30 min for cell lysis, followed by 85° C. for 10 min to inactivate the proteinase K. Expanded clones were collected and cryopreserved.

Analysis of ETV2 gene-edits: Primers flanking the intended sites listed in Table 1 were used to conduct PCR using GoTaq Green Master Mix (Promega) with 1 μl of the cell lysate. Clones having deletion of the entire ETV2 gene were identified from the PCR amplicons by agarose gel electrophoresis. Four different PCR assays were used to identify biallelic ETV2 null clones. All of the PCR conditions included an initial denaturation of 98° C. for 2 min followed by 33 cycles of 10 sec at 98° C., 30 sec at 58° C., and 30 sec at 72° C. A small PCR product of ~580 bp using primers flanking the two gRNAs would confirm biallelic deletion of the gene as the full 3160 bp product cannot be generated with the short extension time used in the amplification cycle. Further PCR reactions, using primers flanking each gRNA, were performed to confirm the absence of an amplicon. Another PCR reaction, using a primer pair internal to the two gRNAs, was performed to rule out ETV2 translocation in the genome. PCR products from clones showing biallelic deletions were cloned into pCR2.1 TOPO (Life Technologies) vector and sequenced using Sanger sequencing method to confirm the deletion of ETV2.

TABLE 1

| Oligonucleotides used Genotyping PCR primers (SEQ ID NOs: 4-17) | |
| --- | --- |
| Primer name | Sequence (5'-3') |
| 5' F1 | GAAGGGCATGATGGATTCTG |
| 5' R1 | GGTAGCTTTGGGGTGTCTTG |
| Internal F1 | GGACTTGTGGAACTGGGATG |
| Internal R1 | CCCTGGGACAGATAAGGATG |
| 3' F1 | ACGCCCATCTGTTGTCAAG |
| 3' R1 | GTCCTCTCAAAGGGGGACAC |
| CF1 | ACAGTCTGCACCACCATTCA |
| CR1 | TGTCTGTTGTGCCCAGTCAT |
| CF2 | CTGGAAAAGCCCTCCAAGAT |
| CR2 | AGCAAAAGACCCGACTCAGA |
| AF1 | CTGCCGTCTCTCTCCTGAGT |

TABLE 1-continued

| | |
|---|---|
| AR1 | AGACTTCCTCTGCCCTCTCC |
| AF2 | GGCCTCTTCATCGGGAAT |
| AR2 | CCCACAGTTGGAGGAGAATC | pPCR primers (SEQ ID NOs: 18-37

| TARGET | SENSE | ANTISENSE | Annealing |
|---|---|---|---|
| ssETV2 | AGTTCCAACTGTGCGACC | CAGCTTCTCATAATTCATGCCG | 60° C. |
| ssEMCN | TCTTCAACCAGCCCCTCTTA | CATTCGATACAAACCCACCA | 60° C. |
| ssTAL1 | ACGCCCCATTCACATTCTG | CCTTCCCTATGTTCGCCAC | 60° C. |
| ssCD45 | TGACAGTGACTCGGAGGAGA | CCTGAGCAGCAATCATCACT | 60° C. |
| ssNKX2-5 | CCCTCGAGCCGATAAGAAAG | ACCTGTGCCTGCGAAAAG | 60° C. |
| ssHAND2 | AGGCGGAAATCAAGAAGACA | TCTTGTCGTTGCTGCTCACT | 60° C. |
| ssHPRT | TAATGACCAGTCAACGGGCGATA | GGATTATGCTGCTTGACCAAGGAA | 60° C. |
| ssACTB | TGCGGCATCCACGAAACTA | GCCGTGATCTCCTTCTGCAT | 56° C. |
| hALU | CGAGGCGGGTGGATCATGAGGT | TCTGTCGCCCAGGCCGGACT | 74° C. |
| hCYTB | GGCTCACTCCTTGGCGC | CCTCGCCCGATGTGTTAGGAAG | 57° C. |

Media components: Media components used for short-term porcine parthenogenote culture are listed in Table 2. mTeSR™1 (STEM CELL Technologies) was used for hiPSC culture and media mixing experiments.

TABLE 2

Composition of culture media for porcine embryos

| Component (mM) | Catalog number | PZM-5 | PZM-MU2 | NCSU-23 | PZM-MU2-HEPES |
|---|---|---|---|---|---|
| NaCl | Sigma S5886 | 108.00 | 108.00 | 108.76 | 105.40 |
| KCl | Sigma P5405 | 10.00 | 10.00 | 4.78 | 10.00 |
| KH2PO4 | Sigma P5655 | 0.35 | 0.35 | 1.19 | 0.35 |
| MgSO4•7M2O | Sigma M7774 | 0.40 | 0.40 | 1.19 | |
| NaHCO3 | Sigma S5761 | 25.00 | 25.00 | 25.07 | 5.00 |
| HEPES | Sigma H0887 | | | | 25.80 |
| Glucose | Sigma G7021 | — | — | 180.20 | |
| Na-Pyruvate | Sigma P4562 | 0.20 | 0.20 | — | 0.20 |
| CaCl2•2H2O | Sigma C7902 | — | — | 1.70 | |
| Ca-(Lactate)2-5H2O | Sigma 21175 | 2.00 | 2.00 | — | |
| Na-lactate | Sigma L7900 | | | | 4.00 |
| L-Glutamine | Sigma G7029 | 2.00 | 1.00 | 1.00 | 1.00 |
| Hypotaurine | Sigma H1384 | 5.00 | 5.00 | 5.00 | 5.00 |
| Taurine | Sigma T8691 | — | — | 7.00 | |
| MEM NEAA (ml/L) | Sigma M7145 | 10.00 | 10.00 | 10.00 | 10.00 |
| BME AA (ml/L) | Sigma B5766 | 20.00 | 10.00 | 20.00 | 10.00 |
| L-Arginine | Sigma A8094 | — | 1.56 | — | 1.56 |
| PS48 | Sigma P0022 | — | 0.005 | — | 0.005 |
| Gentamicin (µg/ml) | Gibco 15710-064 | 10.00 | 10.00 | 10.00 | 10.00 |
| Phenol red (µg/ml) | Sigma P0290 | — | — | 5.00 | 2.00 |
| BSA FAF (mg/ml) | Sigma A8806 | — | 3.00 | 4.00 | 3.00 |
| Polyvinyl alcohol (mg/ml) | Sigma P8136 | 3.00 | — | — | |

PZM-5, Porcine Zygote Medium-5 (24, 25)
PZM-MU2, PZM-Missouri University 2 medium (26)
NCSU-23, North Carolina State University-23 medium (17, 27)
MEM NEAA, Minimum Essential Medium Non-Essential Amino Acids
BME AA, Basal Medium Eagle Amino Acids
BSA FAF, bovine serum albumin, fatty acid free Parthenogenetic embryos: Activated oocytes were obtained from a commercial supplier (DeSoto Biosciences) or generated in-house by using oocytes aspirated from gilt ovaries obtained from local farms. Briefly, for the DeSoto parthenogenesis, cumulus oocytes complexes were collected from mature sows and placed in maturation medium. Oocytes were denuded in a hyaluronidase solution (2 mg/ml) 40-44 hrs post-maturation. Mature oocytes were electrically activated with two DC pulses of 1.5 kV/cm for 30 μsec each, delivered by a BTX Electro Cell Manipulator (Biotechnologies and Experimental Research). For in-house parthenogenesis, cumulus oocytes from gilts were matured for 40-42 hours and then were denuded in a hyaluronidase solution (0.3 mg/ml). They were activated by two DC pulses of 1.2 kV/cm for 30 μsec. After activation, the presumptive pseudo-zygotes were incubated for 4 h in PZM-MU2 medium containing 7.5 μg/ml cytochalasin B. DeSoto embryos were loaded in vials containing pre-equilibrated NCSU-23 medium and shipped overnight in a portable incubator at 38.5° C. Parthenogenotes were cultured in a 500 μl drop of PZM-MU2 medium at 38.5° C. under 5% $CO_2$–5% $O_2$, covered with mineral oil to avoid evaporation.

Generation of ETV2 mutant embryos: ETV2 mutant or GFP embryos were generated by somatic cell nuclear transfer (SCNT) as previously described (17, 18). Briefly, pig primary oocytes complexes (COCs) aspirated from ovarian follicles were cultured in vitro for 40 to 42 h in medium-199 (Corning, 10-060-CV) with 10 ng/ml epidermal growth factor (EGF, Sigma, E4127), 0.5 μg/ml follicle stimulating hormone (FSH, Sigma, F2293), 0.5 μg/ml luteinizing hormone (LH, Sigma, L5269), 3.05 mM D-glucose (Sigma, G6152), 0.91 mM Na-pyruvate (Sigma, P4562), 0.57 mM L-cysteine (Sigma, C7352), 40 ng/ml fibroblast growth factor-basic (bFGF, Sigma, F0291), 20 ng/ml insulin-like growth factor (IGF, Prospec, CYT-022), 20 ng/ml leukemia inhibitory factor (LIF, Millipore, LIF1050), 10 μg/ml gentamicin (Gibco, 15710-064) and 0.1% polyvinyl alcohol (Sigma, P8136) for 40-42 h at 38.5° C. and 5% $CO_2$ in humidified air (10). The matured oocytes with extrusion of the first polar body were enucleated in manipulation medium drop by aspirating the polar body with approximately 10% of cytoplasm adjacent to the polar body together using micro manipulators. The manipulation medium consisted of medium-199 (Gibco, 31100-027) supplemented with 30 mM NaCl (Sigma, S5886), 595 μM $NaHCO_3$ (Sigma, S5761), 2.9 mM HEPES (Sigma, H3784) and 10 μg/ml gentamicin (Gibco, 15710-064). ETV2 mutant or GFP transgenic fibroblasts prepared in advance on a tissue culture plate were harvested on the day of SCNT. The single fibroblast was placed into the perivitelline space of each enucleated oocyte, and then the nucleus of the fibroblast was fused with each oocyte by two direct current pulses of 1.2 kV/cm for 30 μsec in 300 mM mannitol (Sigma, M9546) supplemented with 0.5 mM HEPES, 0.1 mM $CaCl_2$ (Sigma, C7902) and $MgCl_2$ (Sigma, M0250).

The fused embryos were activated in 0.2 mM thimerosal (Sigma, T8784) for 10 minutes and in 8 mM dithiothreitol (Sigma, D5545) for 30 minutes (19). For the in vitro culture of pig SCNT embryos PZM-MU2 media was used, and in the initial 14 to 16 hrs of culture, the histone deacetylase inhibitor (Scriptaid, 0.5 μM; Sigma, S7817) was supplemented to enhance the epigenetic reprogramming of the embryos (20, 21).

Injections of blastomeres and hiPSCs into parthenogenotes: Preparation of blastomeres and injection are described under ETV2 mutant embryo complementation. For long-term culture (FIG. S3), Two GFP-labeled blastomeres were injected into the D4-compacted morula stage embryo and cultured in PZM-MU2 at 38.5° C. under 5% $CO_2$ and 5% $O2$, covered with mineral oil to avoid evaporation. For hiPSC injection studies, two to five iPSC as described in the text, were injected and cultured in a media cocktail containing PZM-MU2-mTeSR™1 (80:20), 10% heat inactivated FBS, 5 mM glucose and 10 mM glycine at 38.5° C. under 5% $CO_2$ and 5% $O2$, covered with mineral oil (22).

ETV2 mutant embryo complementation (injection of blastomeres and hiPSC to ETV2 mutant embryos and in vivo transfer): The injection for embryo complementation was done at 4 days following SCNT. GFP embryo blastomeres were inserted into the ETV2 mutant embryos for the embryo complementation. The GFP blastomeres were prepared after decompaction in PZM-HEPES with 0.1 mM EDTA (Invitrogen, 15575-038) and the zona pellucida was removed by pipetting in 0.2% pronase (Roche, 10165921001) in PBS until it was completely removed. The dissociated blastomeres were washed once in PZM-HEPES supplemented with 20% FBS and twice in PZM-HEPES medium. The ETV2 mutant embryos were decompacted in the same way. The GFP blastomeres were inserted using a micro capillary which has 40 μm inner diameter through the perforation on the zona pellucida of the ETV2 mutant embryos made by using the laser system (Hamilton Thorne, MA, USA). For in vitro long-term culture (FIG. 3I), 2 to 8 blastomeres (half the number of host blastomeres) were injected into each of 4- to 16-cell stage embryos in PZM-HEPES medium, respectively. Injections of cGFP$^+$-hiPSCs or cGFP-BCL2 hiPSCs were performed using the same procedure and injecting 4 hiPSCs per embryo. Transfer of embryos into hormonally primed gilts was performed using published methods (18).

Immunohistochemical analysis of sections and embryos. Sections: Immunohistochemistry was performed on sections as previously described (5). Embryos: In vitro-cultured parthenogenotes were fixed in 4% paraformaldehyde on ice for 10 min, washed 3 times in 0.05% tween-20 in PBS (PBST), and permeabilized in 0.1% Triton X-100 in PBS for 10 min. Afterward embryos were washed 3 times in PBST and transferred to blocking solution (10% normal donkey serum in PBST) for 1 h. After blocking, embryos were incubated at 4° C. overnight with the primary antibody diluted in blocking solution. On the second day, the embryos were washed 3 times with PBST, and then incubated in the secondary antibody conjugated with fluorophores for 1 hr. After incubation, the embryos were washed with PBST for 3 times and then counter-stained with 10 μg/ml Hoechst 33342 or DAPI for 10 min.

Antibodies used: Green fluorescent protein (1:500, Abcam ab13970), Endomucin (1:400, Abcam ab106100), TIE2 (1:200, eBioscience 14-5987), GATA4 (1:500, R&D systems AF2606), DESMIN (1:400, Abcam ab6322), SMA (1:100, Abcam ab7817), SM22 (1:500, Abcam ab14106), NKX2-5 (1:800, Santa Cruz sc-8697), CONNEXIN 43 (1:200, Abcam ab11370), E-CADHERIN (1:200, BD 610181), OCT4 (1:400, H-134 Santa Cruz sc9081), CDX2 (1:200, Biogenex MU392-A-UC), GFP (1:400, Abcam ab13970), HUMAN NUCLEAR ANTIGEN (HNA) (1:100, Abcam ab191181), BrdU (1:500, AbD Serotec OBT0030), human CD31 (1:400, BD Biosciences 550274), VWF (1:200, Novocastra 404705) and BCL2 (1:500, C21 Santa Cruz sc-783; immunoblot). Stained sections were dehydrated and mounted in DPX (Electron Microscopy Sciences 13510).

FACS analysis: Dissociation and immunostaining of the cells from EBs were performed as previously described and analyzed using a FACSAria (BD) (4). Pig and mouse embryos were washed with PBS without $Ca^{++}/Mg^{++}$, then dissociated with collagenase type II (1 mg/ml)/dispase (2 mg/ml) (ThermoFisher Scientific) for 10 min, followed by addition of trypsin/EDTA (0.05%) for 5 min at 37° C. The antibodies used for FACS included: anti-mouse Flk1-APC (clone Avas12a1; eBioscience, 17-5821), anti-mouse Tie2-PE (clone TEK4; eBioscience, 12-5987), anti-mouse CD41-PECy7 (clone MWReg30; eBioscience 25-0411), anti-pig CD31-PE (clone LCI-4; Biorad MCA1746PE) and anti-pig CD45 Alexa Fluor 647 (clone K252.1E4; Biorad MCA1222A647). Propidium Iodide (Thermo Fisher, P3566) was used to exclude dead cells. All data acquired were analyzed with FlowJo ver. 10.4.2 (FowJo, LLC).

Hematopoietic assay: Following dissociation as described above, cells were washed once with PBS, filtered through a 40 μm strainer, and plated for hematopoietic colony forming culture or co-cultured with mouse OP9 bone marrow stromal cells. For fetal liver samples, cells were mechanically homogenized and lysed with RBC lysis buffer (BD Biosciences). For Methylcellulose colony forming assay, 60,000 cells were transferred on human methylcellulose base medium (HSC002, R&D systems) with 20 ng/ml each of sSCF, sIL-3, sGM-CSF, sEPO, sIL-6, and hTPO. All swine cytokines were purchased from KingFisher Biotech, and human TPO was purchased from Shenandoah Biotechnology. Hematopoietic colonies were counted after 12-14 days. For OP9 co-culture assay, $3\times10^5$ cells were cultured on a monolayer of mouse OP9 stromal cells in α-MEM with 20% FBS, sSCF (50 ng/mL), hTPO (50 ng/mL), sIL-3 (20 ng/ml), sGM-CSF (20 ng/mL), and sIL-6 (20 ng/mL). Medium was replaced every 3 days. At day 7, whole co-cultured cells were trypsinized, filtered with a 40 μm cell strainer, and analyzed by flow cytometry.

Genomic in situ hybridization: In situ hybridization was done according to the standard protocols with NBT-BCIP as a substrate (23). Human ALUII probe was purchased from Biogenex.

EdU detection of parthenotes: The Click-iT EdU Alexa Fluor 647 Imaging Kit (ThermoFisher) was used to visualize EdU labeled hiPS cells.

Quantitative RT-PCR: Genomic DNA was purified using Wizard® genomic DNA purification kit. RNA was purified using RNeasy mini kit (Qiagen). Table 1 includes all primers used for qPCR. The GFP primer was obtained from ABI (Mr04329676_mr).

Imaging and statistical analysis: Sections were imaged using a laser confocal microscope (Zeiss LM510). Whole-mount parthenotes were placed in PBS covered with mineral oil in a glass-bottom dish and imaged on fluorescent microscope (Olympus IX83), an inverted confocal microscope (Nikon, A1R confocal laser microscope system) or a deconvolution microscope (Nikon TiE). For quantification, at least 10 fields of different levels of sections were randomly chosen and counted. Statistical analyses were done with 1-way ANOVA.

TetraZ assay: hiPSC were cultured in mTeSR and passaged onto 48 well multiwell clusters coated with Matrigel to achieve 15-20% confluency. When the cells reached 50% confluency, media were replaced with 300p of mixed media (NCSU-23 or PZM-MU2 and mTeSR™1 at indicated ratios) and cultured at indicated temperatures. Media was replaced daily. At 48 hrs after plating, cells were fed with fresh mTeSR™1 for an hour, then 20 s of TetraZ reagent (Biolegend, TetraZ™ Cell Counting Kit) was added to each well, and further incubated for 4 h at 37° C. At the end of incubation, supernatants were assayed following manufacturer's instructions. Assays were performed in quadruplicate.

Calcein transfer from injected hiPSCs to pig blastomeres through gap junctions: Prior to dissociation, shiPS9.1 cells were incubated with 2 μM Calcein AM (Invitrogen, L3224) and 5 μM DiI (Molecular Probes, V-22885) diluted in mTeSR™1 containing 10 μM ROCKi for 20 min. D4 parthenotes were decompacted in 0.1 mM EDTA diluted with PZM-HEPES. Four cells loaded with Calcein AM and labeled with DiI were injected into each parthenogenote. The injected parthenogenotes were cultured in mTeSR™1 containing 10 μM ROCKi for 4 h, at which time the culture medium was replaced with media mixture containing 80% PZM-MU2 20% mTeSR™1 and the parthenogenotes were cultured for an additional 24 h at 38.5° C. After 24 hrs, live parthenogenotes were examined using fluorescence microscopy (Olympus IX83, Japan).

Data disclosures: No data were excluded from these studies and all attempts at replication for standard assays (i.e. FACS, qPCR, methylcellulose colony assays, immunohistochemistry) were successful. Investigators were blinded whenever possible (e.g., FACS analysis, manual cell counting, culture studies, qPCR, etc.). Embryos were processed, however, in the order that they were delivered to maximize preservation and to inform next steps which limited investigator blindness in some instances.

Single cell RNA-seq of porcine morulae: Two to 4-cell pig embryos were harvested from naturally-bred pigs 2- to 3-days post-mating. The uterus was harvested at the abattoir and was subsequently flushed with warm PBS to remove embryos. Harvested 2- to 4-cell embryos were cultured in PGEM-MU2 media for 1- to 2-days at 38.5° C. in an incubator with 5% $CO_2$ and 5% $O_2$ until they developed to compacted morula stage. At this stage the morulae were treated with pronase to remove zona pellucida, followed by EDTA-treatment for decompaction. Each single cell was picked manually into individual wells of a 96-well PCR plate on ice. First-strand cDNA synthesis and full-length double stranded cDNA amplification was performed using the SMARTSeq v4 Ultra Low Input RNA Kit for Sequencing according to the recommended protocol. Each cell was collected in ~1 μl volume. A quarter of the recommended amount of each reagent was used for the cDNA synthesis and double-stranded cDNA amplification reactions for optimal results with the low input RNA from a single cell. Amplified double-stranded cDNAs were purified and validated by the bioanalyzer. Library preparation was performed using the Illumina kit according to manufacturer's protocols. All libraries were sequenced using 75-bp paired end sequencing on NextSeq (Illuminia). The sequencing reads were mapped to porcine genome (susScr3) using TopHat (v2.0.13) and the raw read counts were obtained by HTSeq (v0.6.0) with default parameters. The cells with less than 500,000 paired reads or less than 50% of mapping rate were removed, resulting in 592 high quality single cells for analysis. The single cell RNA-seq data of 18,787 human iPSCs were obtained from Nguyen et al. (28). The raw reads were mapped to human genome (hg19) using TopHat (v2.0.13) (29) and the raw read counts were obtained by HTSeq (v0.6.0) (30) with default parameters. To combine the hiPSC data with porcine data, we mapped the porcine genes to human orthologs using R's BiomaRt package, and only kept the porcine genes that can be uniquely mapped to the human orthologs. 5,000 hiPSC single cells were randomly sampled and combined them with 592 porcine morula single cells. The Seurat alignment (31) was utilized to remove the batch effects of human and porcine cells.

Results and Discussion

Although previous studies support engineering exogenous organs in animals by using human pluripotent stem cells, the resulting chimeric organs, however, would still retain a host-derived endothelium capable of eliciting a hyperacute rejection following transplantation (1, 2). Therefore, the goal was to engineer animals that have an exogenous endothelial lineage.

Etv2 is a master regulator of hematoendothelial lineages as Etv2 mutant mouse embryos were lethal early during embryogenesis and lacked hematoendothelial lineages (3-5). Studies were conducted in mouse and pig to determine whether embryo complementation, in a cell autonomous fashion, could rescue the respective Etv2 mutant embryos by using in vitro and in vivo strategies. Initially, mouse embryonic stem (ES) cells and embryoid body (EB) formation (ES/EB system) was used to evaluate the mesodermal potential of ES cells (4-7). The EYFP-labeled wildtype mES cell line 7AC5 (EYFP) (8), non-labeled wildtype (WT), and Etv2 mutant (null) mES cells (7) were differentiated either separately or in combination and the induction of endothelial (Flk1$^+$/Tie2$^+$) and hematopoietic (CD41*) lineage markers were evaluated by using flow cytometry. Differentiation of EYFP-labeled WT cells alone resulted in more than 95 and 94%, of the endothelial and hematopoietic cells, respectively, that expressed EYFP (approximately 5% of the differentiated cells did not express EYFP suggesting that some cells silenced EYFP expression). Similarly, when EYFP-labeled WT cells were co-cultured with Etv2 null cells, 94 and 92% of the endothelial and hematopoietic populations, respectively, expressed EYFP, and the lineage differentiation was indistinguishable from that of EYFP-labeled WT cells alone. Embryo complementation studies were then performed by using the Etv2 mutant mouse model. Hemizygous mice for two different Etv2 mutant lineages Etv2$^{KO/+}$ (4) and Etv2$^{dKI/+}$ (9) were bred to generate compound Etv2$^{dKI/KO}$ knockout embryos. As this compound mutant could be identified genotypically for the presence of each mutant allele, null embryos could be unambiguously identified in the presence of wildtype complementing cells. Blastocysts from these compound mutants were isolated, complemented with EYFP-labeled WT ES cells and implanted in pseudo-pregnant dams. Immunohistochemical and FACS analyses revealed that the complemented chimeric Etv2 null mouse embryos were viable and that the endothelial and hematopoietic lineages were rescued. Furthermore, it was demonstrated in these chimeric embryos that the hematoendothelial lineages were entirely EYFP positive. These in vitro and in vivo complementation studies further supported that complementation was a cell autonomous event and the WT mouse ES cells could rescue the Etv2 null mouse phenotype.

To generate a porcine platform for endothelial and hematopoietic replacement, it was examined whether the porcine ETV2 mutant embryo phenocopied the mouse mutants and lacked hematoendothelial lineages. The ETV2 gene was deleted in a biallelic fashion in porcine embryonic fibroblasts by using CRISPR/Cas9 gene editing technologies (10). Embryos (n=898) were cloned using SCNT and transferred to seven synchronized gilts (11). At E18, embryos (n=24) were collected and analyzed by using morphological, immunohistochemical, FACS, hematopoietic colony forming assays, and qRT-PCR techniques (FIG. 1). Morphologically, ETV2 KO embryos were growth retarded and appeared pale compared to stage matched WT controls (FIG. 1A, B). Immunohistochemical analysis using the TIE2 and VWF antisera revealed the presence of vasculature in the WT embryos (FIGS. 1C and 1E), which was completely absent in the mutant embryo (FIGS. 1D and 1F). In the WT embryo, it was observed that TIE2 positive vessels in the yolk sac contained blood cells, while these cells were completely absent in the mutants (FIG. 1G, H). In contrast, GATA4, DESMIN, NKX2-5, and smooth muscle actin (SMA), which stain the cardiac lineage, were present in the hearts of both the WT and ETV2 mutants (FIG. 1C-F). Using FACS, the WT embryos displayed a CD45$^+$ CD31 hematopoietic population and a CD31$^+$/CD45$^-$ endothelial population, but both cell populations were absent in the mutant embryos (FIGS. 1I and J). After co-culture with OP9 cells, the CD45$^+$ hematopoietic population and the CD31$^+$ endothelial population expanded from WT embryos, but not from ETV2 KO embryos (FIG. 1K, L). Furthermore, methylcellulose assays revealed an absence of hematopoietic colony forming units in ETV2 KO embryos (FIG. 1M). Additionally, the lack of hematoendothelial lineages in the ETV2 KO embryos was confirmed using qRT-PCR (FIG. 1N-Q). NKX2-5 and HAND2 transcripts were increased in the ETV2 mutants (FIG. 1R, S), similar to the observation in mouse mutants (4). Collectively, these studies established that the porcine ETV2 mutants lacked hematoendothelial lineages and phenocopied the Etv2 null mouse (3-7).

Having defined the null phenotype, it was assessed whether porcine endothelial and hematopoietic lineages of the ETV2 mutant could be complemented in a cell-autonomous fashion. First, GFP-labeled porcine blastomeres were used as the donor cells and their viability and integration into porcine host parthenogenetic embryos (parthenogenotes) and long-term culture in vitro was examined. In these experiments, two GFP-labeled blastomeres were injected into D4 pig morulae and examined every 48 hrs. Although the number of embryos containing GFP$^+$ cells decreased over time, the number of GFP$^+$ cells within embryos increased 2 to 5-fold. These results indicated that the injected GFP-blastomeres not only survived but proliferated in the developing blastocysts. Immunohistochemical staining revealed that the donor cells contributed to both OCT4$^+$/CDX2− and OCT4$^+$/CDX2$^+$ populations, which represent the inner cell mass and trophectoderm, respectively, and confirmed that donor blastomeres express markers for both lineages in the host environment.

Figure 2:
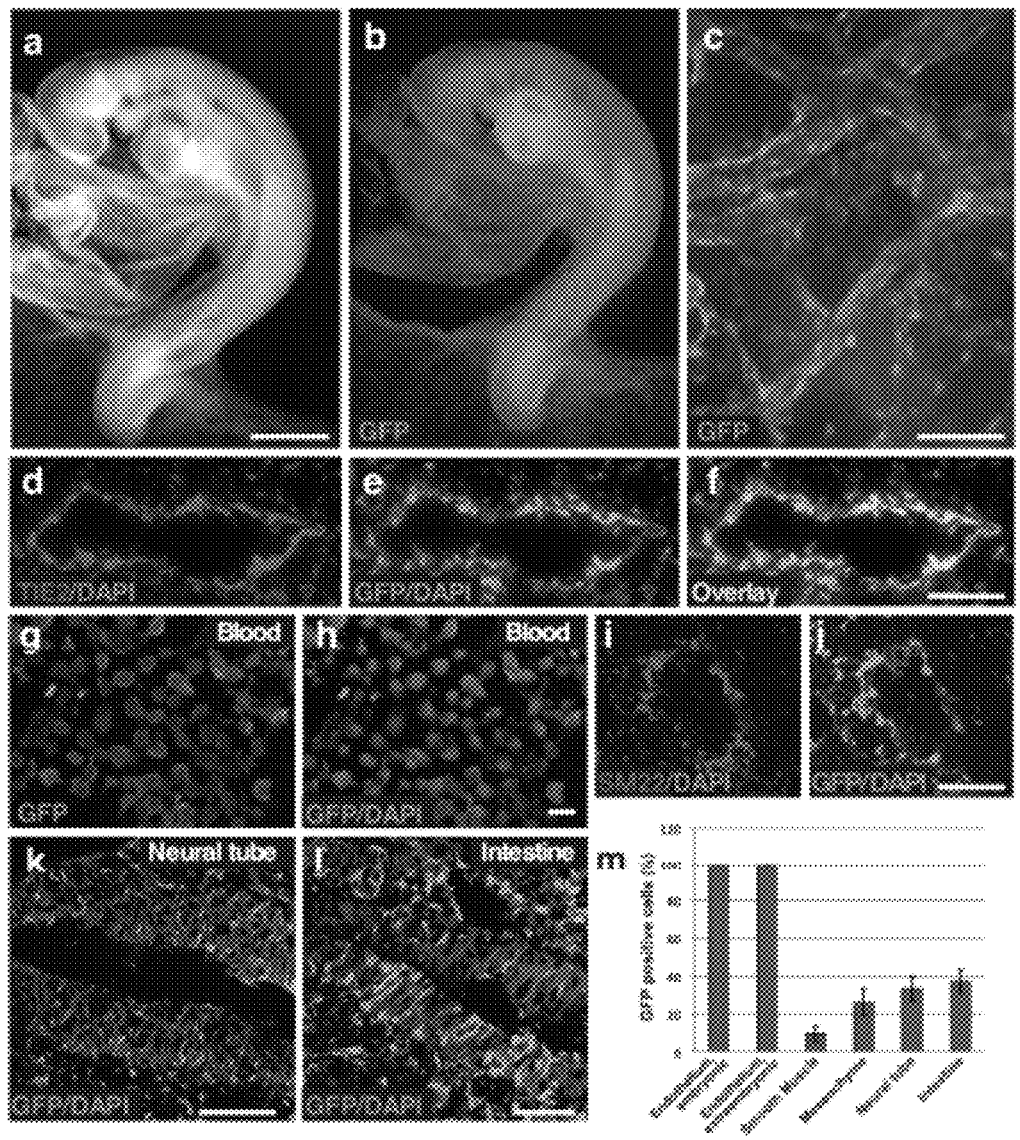
FIGS. 2A-M. Complementation of the hematoendothelial lineages by GFP-labeled blastomeres in the ETV2 knockout embryos. A total of 1,322 complemented embryos were transferred to 8 pseudopregnant gilts and 8 WT-ETV2 null porcine complemented embryos were analyzed. (a-c) Wholemount views of a E18 complemented embryo under brightfield (a) or GFP epifluorescence (b). (c) is a high magnification image of the allantois. (d-l) Cross sections were stained with antibodies to GFP (e-h, j-l), TIE2 (d, f), and SM22 (i). DAPI is used as a nuclear counterstain (d, e, h, i, j, k, l). Scale bars, 1 mm (a, b), 100 m (c), 50 μm (d-f, j-n), or 10 μm (g, h). (m) Percentage of GFP$^+$ cells in different tissues in the complemented embryo. Endothelial (n=632) and smooth muscle (n=237) lineages were identified by immunohistochemistry. Mesenchyme (n=1,219), Neural tube (n=2,043) and Intestine (n=668) were defined morphologically. Note that both embryonic and extraembryonic endothelial lineages are derived 100% from GFP$^+$ cells, whereas other tissues are chimeric. Scale bars, 1 mm (a, b), 100 μm (c), 50 μm (d-f, i-l), or 10 μm (g, h). Total number of GFP$^+$ cells analyzed include 4,799 cells. Data represent mean±SEM.

Having confirmed the integration of GFP-blastomeres into parthenogenetic embryos, complementation of ETV2 mutant embryos was performed. ETV2 mutant embryos and GFP-labeled WT embryos were separately generated by SCNT. On day 4 of culture, ETV2 mutant embryos were injected with GFP-labeled WT blastomeres and transferred into synchronized gilts. The phenotype of the complemented E18 embryos ranged from those that were indistinguishable from ETV2 mutant embryos to those morphologically similar to WT embryos (FIG. 2A). Examination of a well-developed embryo revealed GFP$^+$ cells distributed throughout the body, and completely lined or decorated all of the vascular structures with GFP cells (FIG. 2B-F). In the hematopoietic lineage, GFP signal was visible in all blood cells examined (FIG. 2G, H). The contribution of GFP$^+$ cells to other lineages was quantitatively analyzed using immunohistochemistry. All TIE2$^+$ endothelial cells co-localized with GFP, whereas only a small subpopulation of SM22$^+$ smooth muscle cells, neuroepithelial cells, mesenchymal cells and intestinal cells were co-localized with GFP (FIG. 2D-M). Complemented embryos harvested at E24 and later gestational stages were subsequently examined, and it was confirmed that endothelial and hematopoietic lineages were complemented exclusively by the donor GFP positive cells and that the lethality of the ETV2 mutant had been rescued.

Next, the development of pig parthenogenotes with and without injection of human induced pluripotent stem cells (hiPSCs) was evaluated in three porcine media. It was observed that parthenogenetic embryos developed equally well in PZM-MU2 and NCSU-23, but less efficiently in PZM-5. It was noted that a significant portion of injected hiPSCs underwent apoptosis in the porcine culture conditions. Thus, it was tested whether survival and proliferation of hiPSCs could be supported by an admixture of hiPSC medium with porcine medium. NCSU-23 and PZM-MU2 media were mixed with mTeSR™1 medium at various ratios and the survival and proliferation of three hiPSC lines were quantified after 72 h at 37° C. and 38.5° C. Superior survival and proliferation of all hiPSC lines was observed at both 37° C. and 38.5° C. when the medium contained at least 20% mTeSR™1. Therefore, it was determined that 80% PZM-MU2/20% mTeSR™1 at 38.5° C. (corresponding to the in vivo porcine temperature) was optimal for hiPSC survival and proliferation. Using these conditions, the number of parthenogenotes retaining live hiPSCs, as well as the number of hiPSCs within the parthenogenotes decreased within the first 2 days after injection. The timing of hiPSC injection affects parthenogenote development, was examined and no significant differences across conditions was observed.

Next, methods to unambiguously identify human cells in the porcine host were developed. Parthenogenotes were injected with DiI- or EdU-labeled hiPSCs and cultured until they reached the blastocyst stage, fixed and examined by fluorescence microscopy for EdU or human nuclear antigen (HNA) expression. A comparison of DiI and anti-HNA immunohistochemistry confirmed that the HNA antibody specifically detected the injected hiPSCs. Likewise, 100% of the EdU-prelabeled hiPSCs were detected with the HNA antibody. Two independent histological methods were developed for the detection of human cells insofar as human and pig pancreatic sections were stained using genomic in situ hybridization with a primate specific ALU probe or immunohistochemically using an anti-HNA antibody. To quantify the human cell contribution, primer pairs specific to human ALU (Yb8) and mitochondrial Cytochrome B genomic sequences were used. These primers were able to detect human genomic DNA mixed with porcine DNA at 1:100,000 and 1:100 ratios, respectively.

Using the optimized conditions, four hiPSCs were injected into the porcine parthenogenotes and examined integration into blastocysts. After 48 h of culture, it was found that hiPSCs had integrated with the host cells and connected via cell adhesion molecules, E-CADHERIN or CONNEXIN-43 (FIG. 3A-D). To examine whether a functional connection was established between hiPSCs and host cells, hiPSCs pre-loaded with DiI and calcein were injected. DiI does not spread between cells, whereas calcein diffuses through gap junctions. GFP positive embryos in which calcein spread from hiPSCs into the host cells were found (FIG. 3E-H). This calcein transfer to porcine cells was not due to hiPSC death (resulting in dye release), since injection of lysate from calcein loaded, mechanically disrupted hiPSCs did not result in labeling of host cells. While the frequency of calcein transfer was low in chimeric embryos (found in less than 1% of the embryos), it was unequivocally demonstrated that hiPSCs can directly integrate with the porcine host. Next, whether hiPSCs could proliferate in the porcine host, long term, was examined. To examine this possibility, parthenogenote culture conditions were established that sustained developmental progression up to 10 days. Two GFP-labeled hiPSCs were injected into a porcine parthenogenote. While the number of chimeric embryos decreased over time, those that contained viable cells had increased numbers of hiPSCs similar to the porcine GFP-blastomeres delivered into the porcine parthenogenotes. Taken together, these results suggested that while there was an initial reduction of viability of the hiPSCs, if hiPSCs successfully integrated into the porcine environment then they survived and proliferated.

Figure 3:
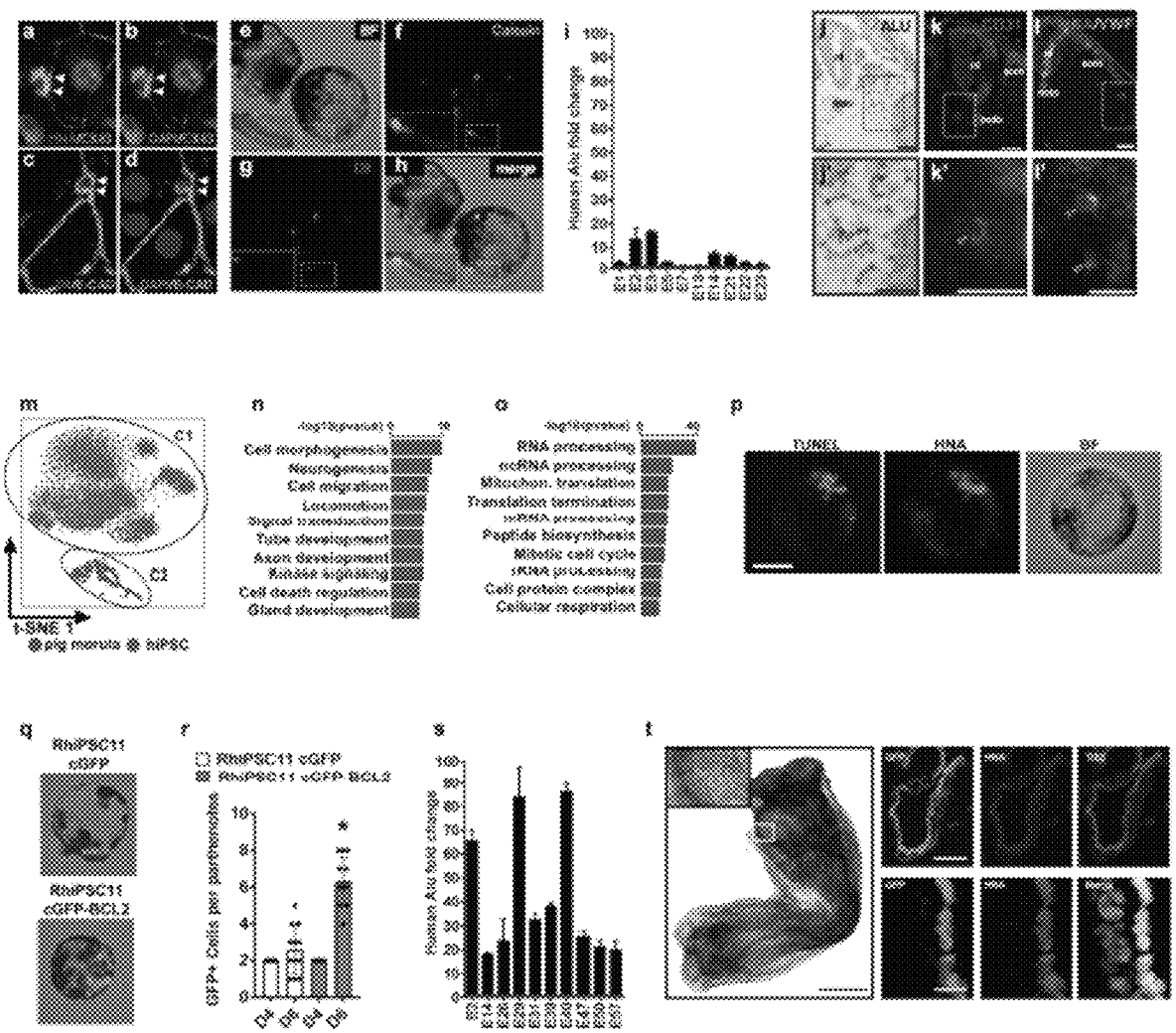
FIGS. 3A-T. (a-d) Porcine parthenogenotes injected with DiI-labeled hiPSCs at the morula stage and cultured in vitro for 48 h. Embryos were fixed and stained with antibodies to CONNEXIN 43 (CX43) and E-CADHERIN (E-CAD), which detect both human and porcine antigens. Co-localization with HNA was also used to identify hiPSCs. Arrowheads point to attachment sites of hiPSC to host cells (n=400). (e-h) Parthenogenotes were injected with hiPSCs loaded with calcein and DiI and examined live after 48 hrs for the spread of calcein. Inset shows calcein spreading from DiI-labeled hiPSC to the neighboring host cells (n=289). (i-l) Analysis of ETV2 mutant embryos injected with hiPSCs. ETV2 knockout blastocysts (n=1,670) were injected with hiPSCs, transferred to 16 synchronized gilts, and analyzed at E18. Total DNA from 23 embryos or embryonic tissue were analyzed for human DNA content (i). Top ten embryos contained detectable human DNA when compared to background pig DNA (p<0.05). Sections were analyzed by ALU in situ hybridization (j,j'), immunohistochemistry against human CD31 (k,k'), HNA and human VWF (l,l'). Panels j', k', and l' are increased magnification of the boxed areas in j, k, and l, respectively. ALU positive cells were found scattered within the embryo (j', arrowheads), and cells that express human antigens were identified (arrowheads in panels k', l'). noto: notochord, nt; neural tube, som; somite. Scale bars, 50 μm. (m-o) Single cell RNA-seq of porcine morulae (n=592 cells) and hiPSCs (n=5,000 cells) using the Seurat algorithm for the batch effect with the definition of two clusters (m) which were characterized using the gene ontology (GO) classification (n and o). (p) Following the delivery of hiPSCs into porcine parthenogenotes and 48 hrs of culture (BF) a subpopulation of the hiPSCs (HNA positive cells) were noted to undergo apoptosis (TUNEL positive cells). (q-t) BCL2 overexpression increases the efficiency of human:porcine chimeras. (q) Representative blastocyst images (Day 6) showing a marked increase in the number of cGFP-BCL2 hiPSCs (bottom panel) vs. control-GFP hiPSCs (top panel) in porcine parthenogenote blastocysts. (r) Quantification of GFP$^+$ hiPSCs per parthenote following the delivery of control cGFP-hiPSCs vs. cGFP-BCL2 hiPSCs. Note significant increase in the number of GFP$^+$ cells per parthenogenote with delivery of the cGFP-BLC2 hiPSCs. Data represent mean±SEM. (s,t) Analysis of ETV2 mutant embryos injected with cGFP-BLC2 hiPSCs. ETV2 knockout blastocysts (n=1,321) were injected with cGFP-BLC2 hiPSCs, transferred to 11 synchronized gilts, and analyzed at E17. Total DNA from 63 embryos or embryonic tissue were analyzed for human DNA content (s). Top ten embryos containing detectable human DNA when compared to background pig DNA are shown (p<0.05). Brightfield wholemount image of the cGFP-BCL2:ETV2 null complemented E18 embryo with inset demonstrating GFP fluorescence (t). Cryosections were analyzed using immunohistochemistry for GFP, HNA and TIE2 demonstrating coexpression (upper panels) (t). Immunohistochemistry for GFP, HNA and DAPI (blue) demonstrate coexpression in the nuclear compartment of the E17 chimera (lower panels) (t).

Embryonic complementation was performed using hiPSCs to examine the integration of hiPSCs in vivo. Singularized hiPSCs were injected into ETV2 mutant blastocysts (hiPSC-ETV2 null porcine embryos), which were transferred to surrogate gilts. Embryos were analyzed at E17-E18. Human cells were detected in embryos by qPCR analysis of genomic DNA. 1,670 hiPSC-ETV2 null porcine embryos were transferred to 16 surrogate gilts and 23 embryos or embryonic tissue were harvested (using qPCR human DNA was detected in twelve of these embryos or embryonic tissue, $p<0.05$; top 10 are presented) (FIG. 3I). 4 out of 7 hiPSC-EFV2 null porcine embryos collected had cell nuclei positive for the ALU sequence by in situ hybridization or HNA immunohistochemistry (FIG. 3J-3L). In adjacent sections, cells positive for HNA, human-specific CD31 and VWF were observed (FIG. 3K, K', L, l=L'). These parallel lines of evidence strongly indicate that hiPSC derived cells were responsive to the developmental cues and differentiated to the endothelial lineage. To identify the distinct molecular programs in porcine morulae and hiPSCs, single cell RNA-seq was used to profile 592 porcine morulae cells and these results were compared with published hiPSC single cell RNA-seq datasets (n=5,000 cells). Seurat alignment was utilized to remove the species differences between human and porcine data. Two clusters were identified (C1, hiPSCs only and C2 pig morulae and hiPSCs) and the pathway analysis revealed that the cells from cluster C1 had increased cell death regulation (FIG. 3M-O). It was also demonstrated that decreased efficiency of human:porcine chimeras using parthenogenotes was due to programmed cell death of the injected hiPSCs (FIG. 3P). Therefore, to increase the efficiency of chimera formation gene editing technologies were used to overexpress the antiapoptotic factor, BCL2, in GFP expressing hiPSCs.

Next, whether cGFP-BCL2 hiPSCs had increased efficiency for human-porcine chimeras in vitro was examined. Two cGFP-labeled BCL2 hiPSCs were injected into a porcine morula parthenogenote, cultured and noted to have increased GFP$^+$ parthenogenotes and increased number of GFP$^+$ cells per parthenogenote (FIG. 3Q-R). The capacity of cGFP-labeled BCL2 hiPSCs for embryonic complementation was examined using the ETV2 null porcine morula, which were transferred to synchronized gilts. Embryos were analyzed at E17. Human cells were detected in embryos by qPCR analysis of genomic DNA. 1,321 hiPSC-ETV2 null porcine embryos were transferred to 11 synchronized gilts and 63 embryos or embryonic tissue were harvested (using qPCR human DNA was detected in 51 of these embryos or embryonic tissue, $p<0.05$; top 10 are presented) (FIG. 3S). These studies reveal that BCL2 overexpression in hiPSCs results in more than a 5-fold increase (compared to the wildtype hiPSCs) in the efficiency of human:porcine chimeras (FIGS. 3S and 3I) correlating to more than 1:2,000 cells. Using wholemount brightfield and epifluorescence microscopy, cGFP expression was observed in the chimeric porcine embryos (FIG. 3T, left). Using immunohistochemistry coexpression of cGFP, HNA and TIE2 was observed (FIG. 3T, right upper panel) and it was noted that the cGFP expressing cells coexpressed HNA in the nuclear compartment at high magnification (FIG. 3T, right lower panel). These parallel lines of evidence strongly indicate that BCL2 overexpression in hiPSCs resulted in increased efficiency of human-porcine chimeras and that these BCL2 overexpressing hiPSCs differentiated to the endothelial lineage. BCL2 overexpressing hiPSCs increased the capacity to produce interspecies chimeras. Moreover, these data demonstrate the successful use of complementation strategies and the feasibility of engineering human-porcine chimeras.

In summary, it is demonstrated that E72 mutant pig embryos lack hematopoietic and vascular lineages. These mutant embryos can be rescued in a cell autonomous fashion in both mouse and pig. These data support that a mutant porcine host is an ideal platform for the generation of humanized endothelial lineage. This is the first report of a rescue of a nonviable mutant porcine phenotype using embryonic complementation. Given the reports of successful exogenous organ production such as pancreas and kidney (1, 2, 12, 13), the data support that the ETV2 mutation can be combined with other gene mutations to generate exogenous organs that have significantly reduced immunogenic potential for transplantation into human patients. The data support the feasibility of the generation of unprecedented humanized disease models for the study of developmental, regenerative, and disease mechanisms which will undoubtedly yield new therapies and allow for the generation of an unlimited supply of humanized organs for transplantation while eliminating the need for immunosuppressive agents.

Example II

Aggregates

Figure 4:
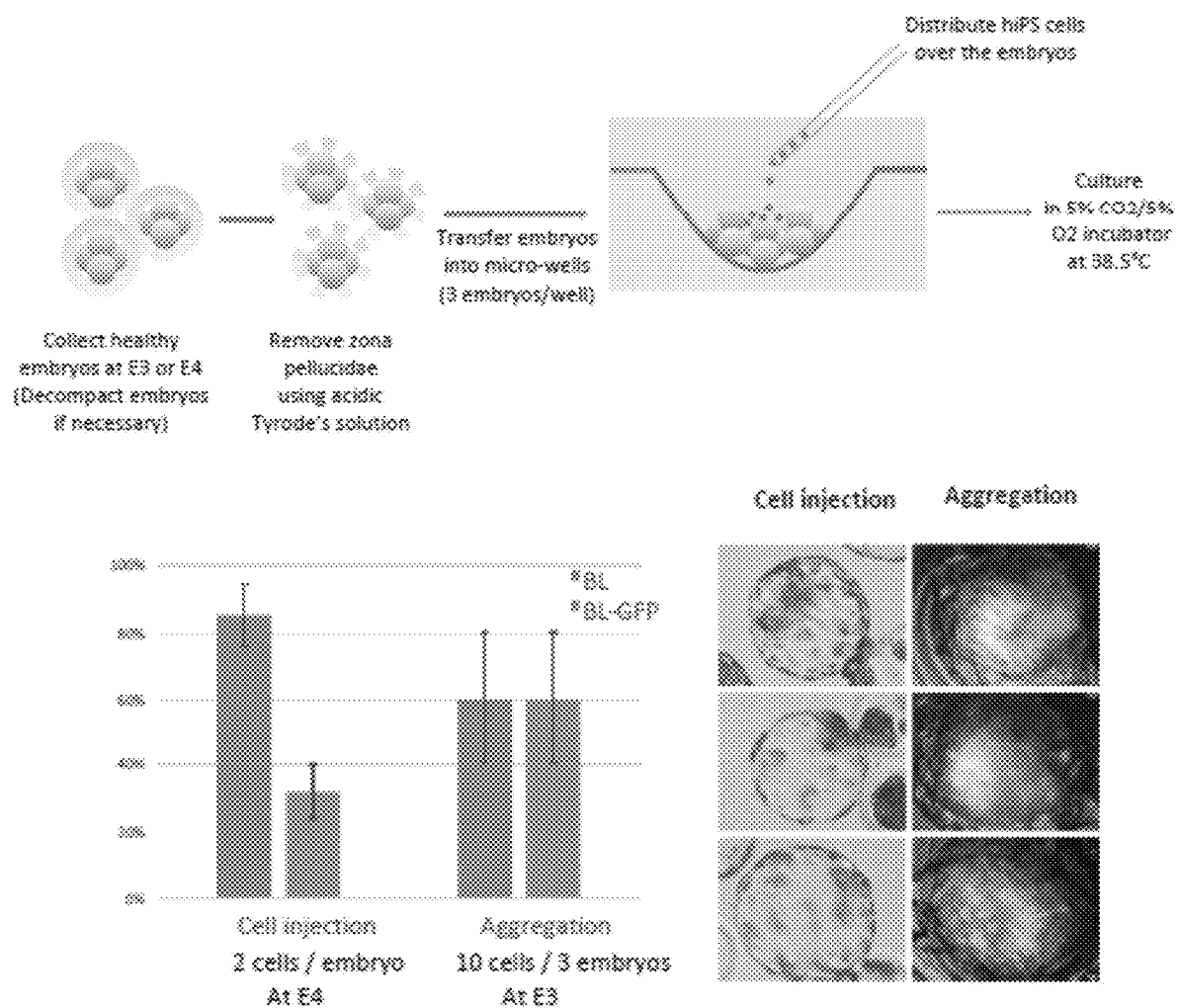
FIG. 4. Strategy for Pig:Human Aggregate generation. Upper panel: 3 mutant embryos are cultured to E3 or E4 at which time the zona pellucidae is removed and all dissociated embryonic material is transferred to microwells. 10 GFP labeled-hiPSCs are distributed over the dissociated embryos and they are cultured to E6 at which time they are evaluated in vitro for hiPSC location and proliferation when compared to pig:human aggregates generated using embryo injection (blastocyst complementation) [lower panel]. Pig: human aggregates yield superior blastocyst-GFP rate when compared to traditional blastocyst complementation strategies.
Figure 8:
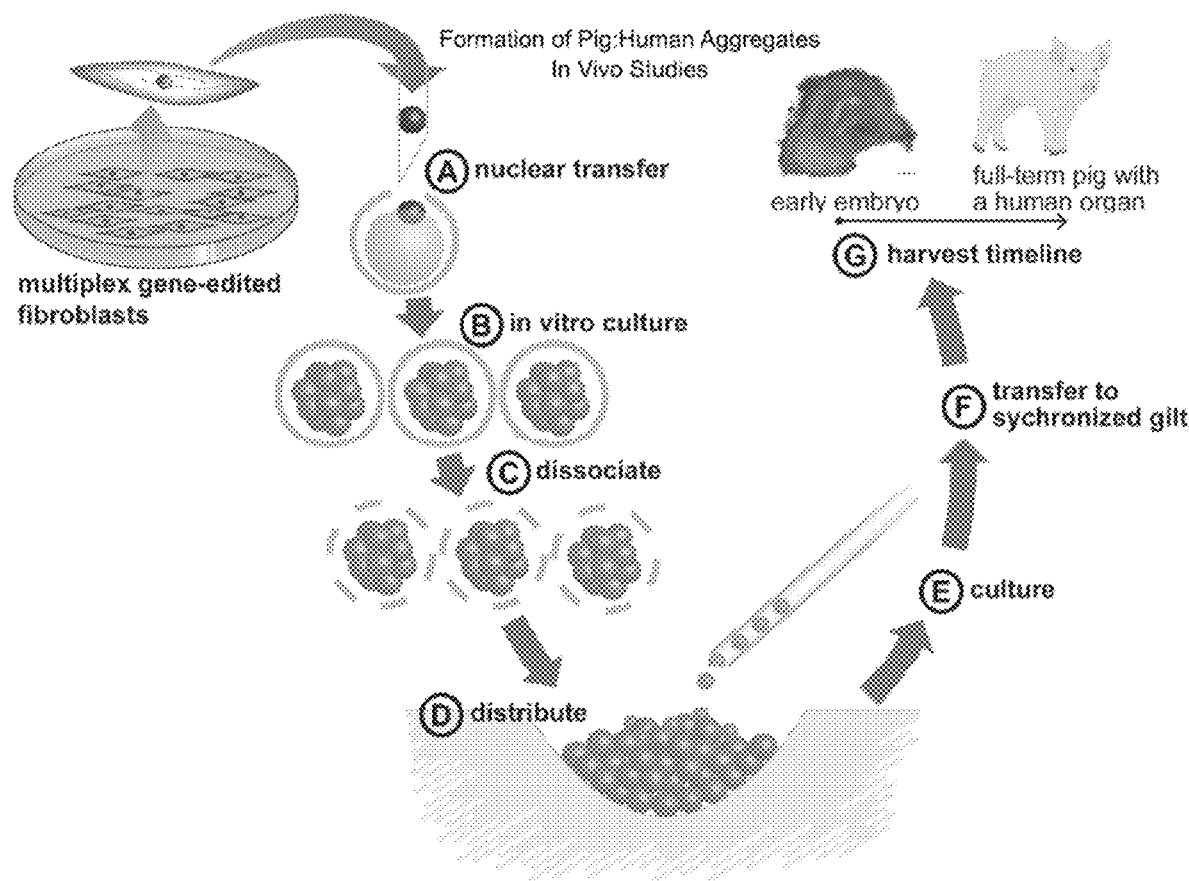
FIG. 8. Schematic of method for formation of Pig:Human aggregates.

This innovation involves the use of multiple, dissociated cloned mutant, dissociated embryos that are layered with hiPSCs and cultured prior to transfer into a synchronized gilt (FIGS. 4 and 8). In vitro it shown that the integration of hiPSCs is superior when layered upon aggregates vs. injection into blastocysts. Additionally, given the potential for epigenetic defects in a single clone, aggregation can serve to compensate for such defects due to increased numbers, paracrine effects, or blastomere mingling. Additionally, aggregation utilizes zona-pellucida free embryos that may be more susceptible to mixing and integration between species.

Example III

TP53 Knock-Out/Knock-Down

The TP53 gene transcription results in the production of tumor protein p53 (or p53). The TP53 binding domain is frequently mutated or silenced in various cancers, releasing normal tumor suppression. These mutations are considered as one of the most important factors in carcinogenesis. The TP53 gene is located on chromosome 17 at the 13.1 position. This protein acts as a tumor suppressor, by regulating cell division and proliferation. The p53 protein is located in the nucleus of cells throughout the body, where it binds directly to DNA. Previous data show that the TP53 knockout in rodents develop normally but later in life develop tumors.

The goal of this work is to knockout/knockdown TP53 in hiPSCs to promote the proliferation of these human cells in mutant porcine embryos. To increase the efficiency of interspecies chimerism, gene edited cGFP-labeled hiPSCs were generated to mutate the TP53 gene. Using these TP53 null cGFP-hiPSCs, SCNT and blastocyst complementation were performed to generate interspecies (human:pig) chimeras and the rescue of the triple null porcine embryo (null in MYF5/MYOD/MYF6) with humanized muscle was confirmed using immunohistochemical and molecular techniques (the interspecies chimeras were harvested at embryonic day 20 (E20) and 27 (E27)).

Figure 7:
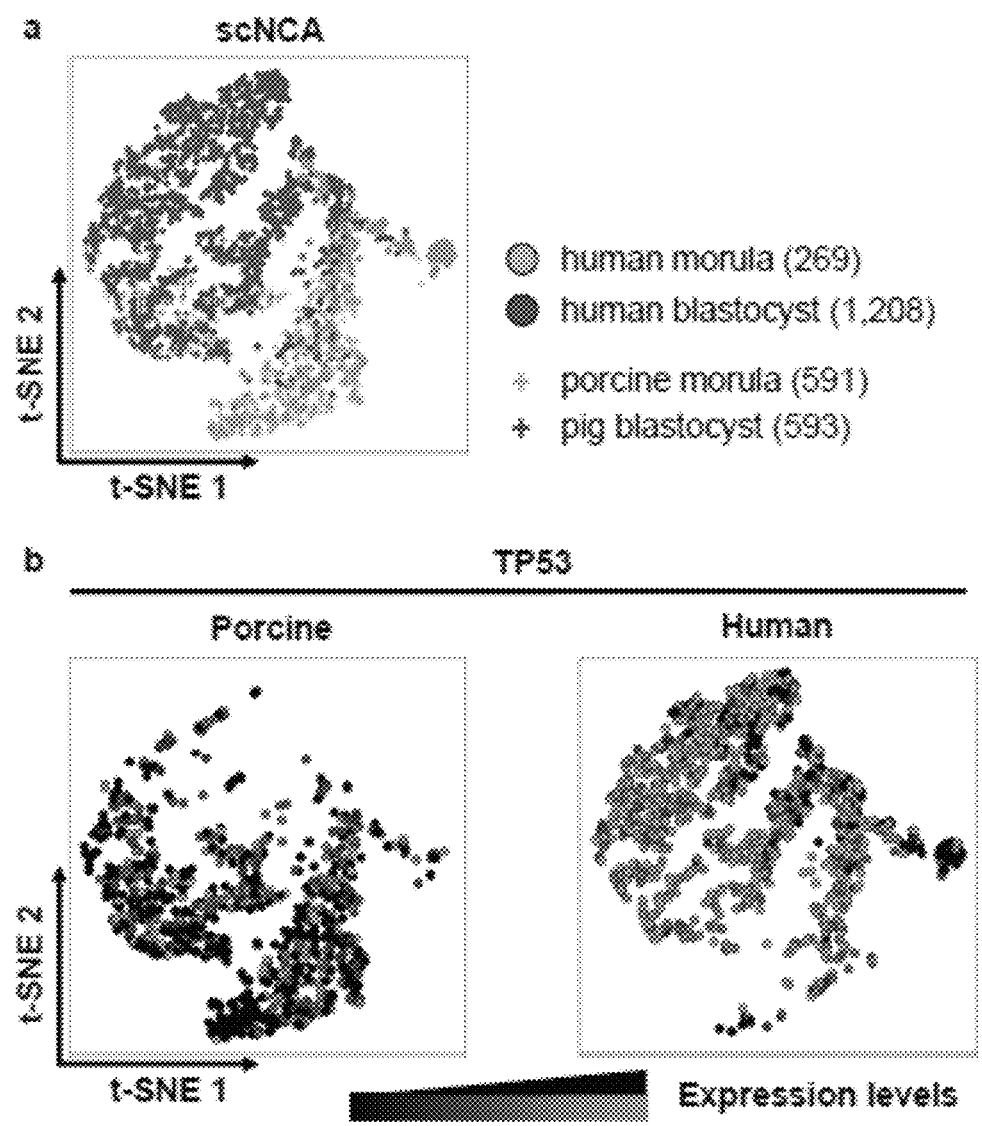
FIGS. 7A-B. Single cell RNA seq data from human and porcine pre-implantation embryos. These data demonstrate higher expression of TP53 in human pre-implantation embryos when compared to porcine pre-implantation embryos. Therefore, by reducing or abolishing TP53 expression in hiPSCs (used for complementation of porcine mutant embryos) to promote molecular similarity between these two species and thereby enhance the chimeric efficiency in the chimeric embryo. As outlined in the figures, the data showing complementation of skeletal muscle null embryos with TP53 knockout hiPSCs confirm this statement.

FIG. 7 demonstrates that TP53 shows significantly higher expression levels in human preimplantation embryos and that from single cell RNA seq data from human and porcine pre-implantation embryos that TP53 knockdown increases efficiency of producing viable human:animal chimera.

Figure 5:
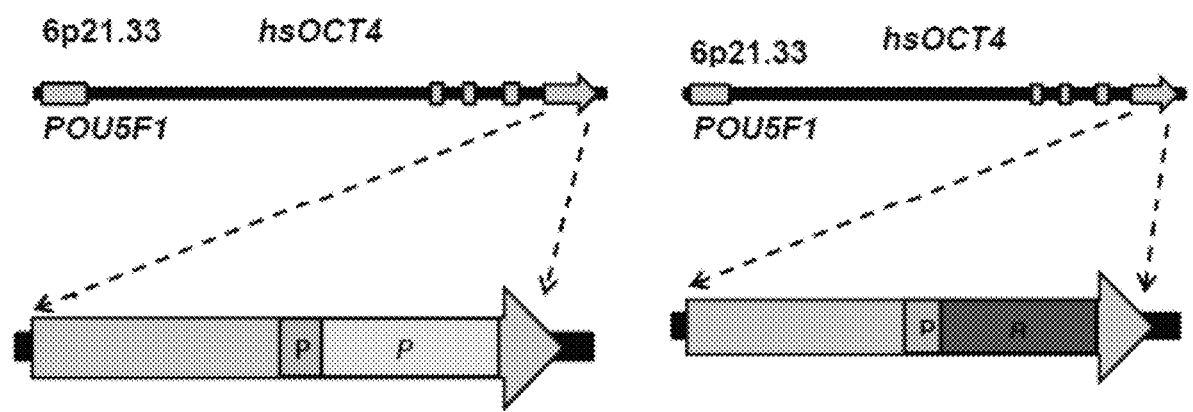
FIG. 5. Human cell genetic modifications: Transgene BCL2 overexpression. OCT4 P2A BCL2—Knock in BCL2 expression under OCT4 promoter. P53 CRISPR KO and/or KD. Loxp sites spanning BCL2 and/or P53 dominant negative-controlled lineage/stage CRE expression.
Figure 6:
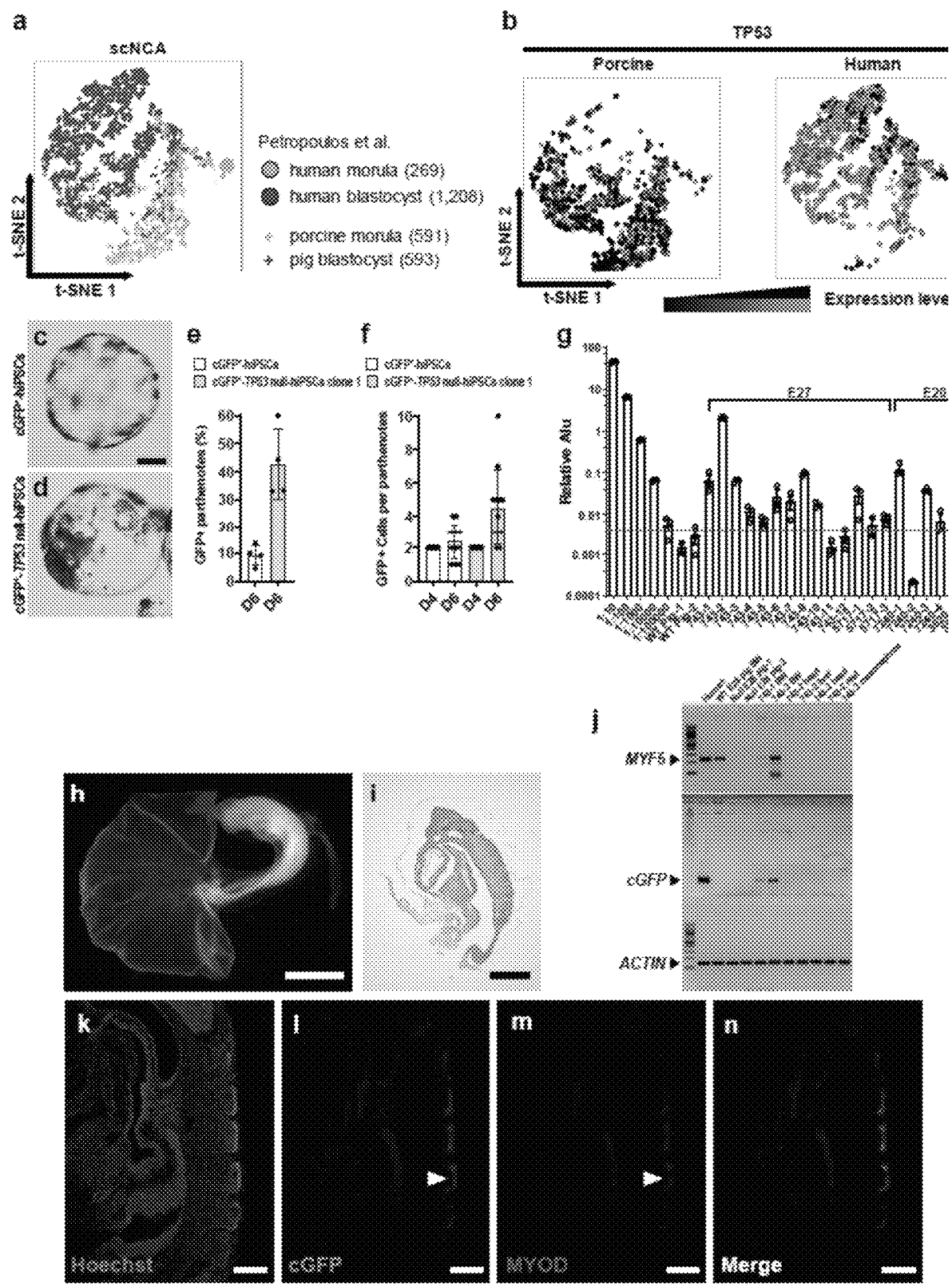
FIG. 6A-N. Analysis of human:pig (cGFP-labeled TP53 null complemented) embryos. a, Single cell RNA-seq datasets of human morula and blastocyst embryos were compared with our single cell RNA-seq datasets of porcine morula and blastocyst embryos. b, We found that the expression levels of TP53 are relatively higher in human embryos than in early porcine developing embryos. c,d, Representative images of the hiPSC integrated parthenogenic blastocysts following injection of control cGFP$^+$-hiPSCs (c) or cGFP$^+$-TP53 null hiPSCs clone 1 (d). e, Quantitative analysis of percent CFP+ parthenogenotes injected with cGFP$^+$-hiPSCs vs. cGFP$^+$-TP53 null hiPSCs at day 6 (D6). f, Quantification of GFP+ cells per parthenogenote following the delivery of control cGFP$^+$-hiPSCs vs. cGFP$^+$-TP53 null hiPSCs at D4 and D6 stages. g, Total DNA harvested from the tail and head tip of cGFP$^+$-TP53 null hiPSCa complemented pig embryos were analyzed by qPCR for human DNA content using human specific Alu primers. h, Whole mount of E20 null embryo complemented with cGFP$^+$-TP53 null hiPSCs. i, H&E staining of section of E20 MYF5/MYOD/MYF6 null embryo complemented with cGFP$^+$-7P53 null hiPSCs. j, RT-PCR results using MYF5/MYOD/MYF6 null or pig-human chimeric embryo cDNA from different parts of embryos to detect human transcripts in the complemented embryos. Human cDNA and E28 WT pig bodywall (BW) cDNA are used as positive samples. BW cDNA from two different MYF5/MYOD/MYF6 null embryos are used as negative controls. Positive MYF5 transcripts are detected in chimeric embryos 743-1 BW and 743-2 BW. Note absence of MYF5 and cGFP transcripts in the heart, liver, mesonephro, and the remainder of the embryo (rest) demonstrating the specificity of the complementation strategy to the myogenic lineage. Arrowhead points to the 226 bp MYF5 product in the upper panel and to the 160 bp cGFP product in the middle panel. cGFP$^+$-TP53 null hiPSC cDNA was used as a positive control for the cGFP PCR. ACTIN in the lower panel is used as a housekeeping transcript for all the samples. k-n, Staining of E20 pig-human chimeric embryo with Hoechst (k) and antibodies directed against cGFP (1). MYOD (m), and two channel merge of cGFP and MYOD (n). Arrowheads mark myotome of somites that are cGFP and MYOD positive. Scale bars, 50 μm (c), 2 mm (h), 500 μm (i), and 200 μm (k-n).

The Oct-4 gene (aka POU5F1) is a homeodomain transcription factor that plays a role in self-renewal of undifferentiated cells. Oct4 expression is tightly regulated and remains active in the embryo only through the preimplantation period. Therefore, the knockout of TP53 will be controlled by placing it under the regulation of the transiently activated Oct4 promoter (FIGS. 5 and 6). The overexpression of BCL2 will also be placed under the control of the Oct-4 promoter (FIG. 5).

Example IV

Introduction

Congenital Heart Disease and advanced heart failure are both common and deadly. Cardiac transplantation is the only cure for heart failure and demand for hearts is significantly greater than the supply of donor hearts. One clinical significance of this invention is the production of a humanized heart using NKX2-5/HANDII/TBX5 knockout pigs as hosts for production. These animals can serve as an organ source for orthotopic heart transplantation into humans. In addition to serving as a novel source of human hearts for the treatment of congenital heart disease and end stage or advanced heart failure, the humanized pigs will serve as a large animal model to study the regeneration of the human heart or response(s) to pharmacological agents or novel devices.

Materials/Methods/Results

Provided herein is: gene editing of porcine fibroblasts to combinatorially mutate NKX2-5, HANDII and TBX5; SCNT generated triple mutant porcine embryos; established that the NX2-5/HANDII/TBX5 triple mutant pig embryos have acardia (lack a heart); verified that human stem cells (hiPSCs) proliferate following the delivery into the porcine blastocyst; verified that human stem cells (hiPSCs) are viable and differentiate following the delivery into the nonviable porcine parthenote embryo (in vitro and in vivo); CRISPR/Cas9 gene editing of porcine embryonic fibroblasts (E35) to combinatorially mutate NKX2-5, HANDII and TBX5; established a premier Cloning (SCNT) laboratory and cloned more than 10,000 embryos during the past one year period; achieved outstanding fusion rates, maturation rates, blastocyst rates and pregnancy rates that exceed those published by the cloning industry; established new hiPSC lines that are at distinct pluripotency states; engineered high efficiency pig-pig chimeras in vitro; established conditions/protocols to achieve the longest described culture periods of pig embryos in vitro; achieved high efficiency human-porcine chimeras in vitro with established integration: engineered new reporter cell lines for porcine experimentation; confirmed that hiPSCs delivered into the developing pig embryo form mesodermal derivatives; established that human stem cells (hiPSCs) are viable and differentiate following the delivery into the nonviable porcine parthenote embryos (in vitro and in vivo).

Gene editing technologies to engineer porcine fibroblasts.

Gene editing technologies were utilized to combinatorially edit, in a biallelic fashion, the NKX2-5, HANDII and the TBX5 loci in porcine fibroblasts (FIG. 9). These mutant fibroblasts were then used for SCNT (i.e. cloning). Cloned, mutant pig embryos were transferred to synchronized gilts and sacrificed at E18. The embryos were genotyped (to assure that they lacked NKX2-5/HANDII/TBX5), immersion fixed in 4% paraformaldehyde, cryoprotected, frozen and 7-micron thick sections were obtained.

Guide RNA (gRNA) design and production.

Candidate gRNA sequences for pig NKX2-5, HAND2 and TBX5 were designed using the online tool "crispr.mit.edu." Two gRNAs per gene to create a small deletion were cloned into a single plasmid following the BsaI-mediated Golden Gate Cloning method using multiplex CRISPR/Cas9 Assembly System kit (Addgene Kit #1000000055). The resulting all-in-one CRISPR/Cas9 vector system having total six gRNAs was sequence verified for correct gRNAs by Sanger sequencing (FIG. 9).

Tissue Culture and Nucleofection.

Pig fibroblasts were maintained at 38.5° C. at 5% $CO_2$ in DMEM supplemented with 15% fetal bovine serum, 5 ng/ml basic fibroblast growth factor, and 10 mg/ml gentamicin. The Nucleofactor 2b device (Lonza) was used to deliver the all-in-one CRISPR/Cas9 plasmid using program U-012. Approximately 600,000 cells were nucleofected with 6 µg of plasmid using the Basic Nucleofector™ Kit for Primary Mammalian Fibroblasts (#VPI-1002). Nucleofected cells were cultured for 2 or 3 days at 38.5° C., and then analyzed for gene editing efficiency and plated for colonies.

Dilution Cloning.

Two- or three-days post nucleofection, 50 cells were seeded onto 10 cm dishes and cultured for two weeks. Colonies were picked on Day 14 after transfection by applying 10 µm autoclaved cloning cylinders around each colony. Colonies were rinsed with PBS and harvested via trypsin; then resuspended in DMEM culture medium. Two thirds of the resuspended colony were transferred into a well of 24-well plate and the remaining one third was collected into a PCR tube. The cell pellets were resuspended in 10 µl of lysis buffer (40 mM Tris, pH 8.9, 0.9% Triton X-100, 0.4 mg/ml proteinase K (NEB)), incubated at 65° C. for 30 min for cell lysis, followed by 85° C. for 10 min to inactivate the proteinase K. Expanded clones were collected and cryopreserved.

Analysis of Gene-Edits.

1 µl of the proteinase K digested cell lysate was used for PCR using primers flanking the intended sites. Clones having small deletions for all three genes were identified from the PCR amplicons by agarose gel electrophoresis. PCR products from clones showing biallelic small deletions were cloned into pCR2.1 TOPO (Life Technologies) vector and sequenced using Sanger sequencing method. Frame shift mutation and premature stop codons were confirmed from the sequence analysis (FIG. 9).

NKX2-5/HANDII/TBX5 mutant porcine embryos lack a heart and are nonviable.

Five triple mutant embryos were isolated which were growth retarded and had no evidence of a heart (grossly). These embryos were fixed and sectioned. Morphologically and immunohistochemically these triple mutant embryos lacked a heart as they had no evidence of Mef2c or Gata4 expression (FIG. 10). These results confirm that NKX2-5, HANDII and TBX5, collectively are necessary for cardiogenesis in the developing pig embryo.

Using these newly engineered porcine fibroblasts, the genotype and phenotype of the triple knockout embryos have been validated. During the past year, the laboratory successfully cloned more than 10,000 porcine embryos and achieved outstanding metrics including a maturation rate that exceeds 80%, a lysis rate less than 5% and a blastocyst rate greater than 35%. These metrics have transformed the laboratory and have impacted the productivity.

Pig-pig complementation to define the highest efficiency chimerism in early (morula) developing porcine embryos.

As a baseline study to define the very best chimerism that one could achieve (with the interspecies chimeras), pig-pig chimeras were examined in vitro. Initially, the lab cloned GFP-labeled embryonic fibroblasts that the lab produced, dissociated the early pig embryos and isolated GFP-labeled pig blastomeres. Also produced were porcine parthenotes that were allowed to developmentally progress (in vitro) to the morula stage. Two blastomeres were injected into each morula and assessed whether the injected cells proliferated and migrated to specific regions of the developing parthenotes. The analysis was restricted to developing parthenotes. Following injection (time=0), it was found that ~40% of the total injected parthenotes contained $GFP^+$ cells at 48 h (2 days). The numbers of $GFP^+$ parthenotes decreased to 20% and 7% at 96 h (4 days) and 144 h (6 days) respectively, post-injection. Next, quantitative analysis of $GFP^+$ cells revealed a 3-4-fold increase in the number of GFP-labeled cells as early as 48 h, indicating the pig blastomeres were able to survive and proliferate using these cell culture conditions (FIG. 11). These GFP-labeled porcine blastomeres and their derivatives migrated and localized to various regions of the developing parthenotes including the ICM and trophoectodermal layer.

Successful in vivo pig-pig complementation using GFP-labeled wildtype blastomeres.

The need to engineer pigs with human vasculature in order to prevent hyperacute rejection of the humanized heart is recognized. Previously it was discovered that Etv2 in the mouse is both necessary and sufficient for the specification and the development of the vascular and blood lineages. It was further established that Etv2 is a master regulator of these lineages. Therefore, using CRISPR/Cas9 gene editing technology, pig embryos were generated that lack ETV2. These mutant embryos are nonviable by E16 and completely lack blood and vascular lineages. To establish the blastocyst complementation technique, the ETV2 null pig embryo was closed and at the morula stage of development, 2-4 GFP-labeled wildtype pig blastomeres were injected and implanted the chimeric embryos into a pseudopregnant gilt and harvested them at E18. The Etv2 null embryo lacks vasculature, blood and is nonviable by E17. Using blastocyst complementation with wildtype GFP-labeled blastomeres the lethality and the absence of the vascular and blood lineages were completely rescued (FIG. 12A-l). Moreover, while the GFP-labeled blastomeres can contribute to other lineages such as smooth muscle, neuronal, and intestinal lineages, they preferentially give rise to the vascular and blood lineages (FIG. 12J-O). The use of the ETV2 null pig embryo is an important advance in engineering humanized vasculature in combination with the humanized heart for therapeutic purposes.

Engineering New hiPSC Cell Lines.

Additional hiPSC lines were generated. This allows for the necessary quality control to monitor drift and changes that may ultimately impact the efficiency related to interspecies chimerism. Human embryonic fibroblasts were infected with a reprogramming STEMCCA-OSKM Doxycycline-inducible viral cassette to generate induced pluripotent stem cells (iPSCs). Reprogramming fibroblasts were grown in doxycycline supplemented media for 30 days until embryonic stem cell like colonies appeared (FIG. 13), then individual colonies were picked and grown in naïve vs. primed conditions. Once iPSCs were established, H2B-EGFP was knocked in to the AAVS1 locus by ZFN mediated targeting (FIG. 13).

Using the hiPSC-EGFP lines, in vitro culture conditions have been established to examine conditions and signaling pathways that could be interrogated and modified to increase the efficiency of human-porcine chimerism (FIG. 14).

hiPSCs and pig blastomeres integrate and form a developmentally competent embryo in vitro.

To confirm that hiPSCs can integrate with the pig blastomeres, dye transfer studies were performed. hiPSCs were loaded with calcein and these cells were further labeled with DiI and injected into the pig parthenotes (FIG. 15). We observed that the pig blastomeres adjacent to the hiPSCs had green fluorescence (FIG. 15). These results indicated that the calcein dye from the hiPSCs was transferred (via gap junctions) to adjacent pig blastomeres.

To exclude the possibility that the GFP-labeling of the pig blastomeres was due to the leakage of calcein from the hiPSCs as a result of cell death/lysis, variable concentrations of Calcein AM were injected into the blastocele (FIG. 16). As shown in FIG. 15, no green fluorescence was observed in the pig blastomeres which further supports the notion that hiPSCs and pig blastomeres integrate and communicate via gap junctions.

Pig-hiPSC Complementation

Figure 17:
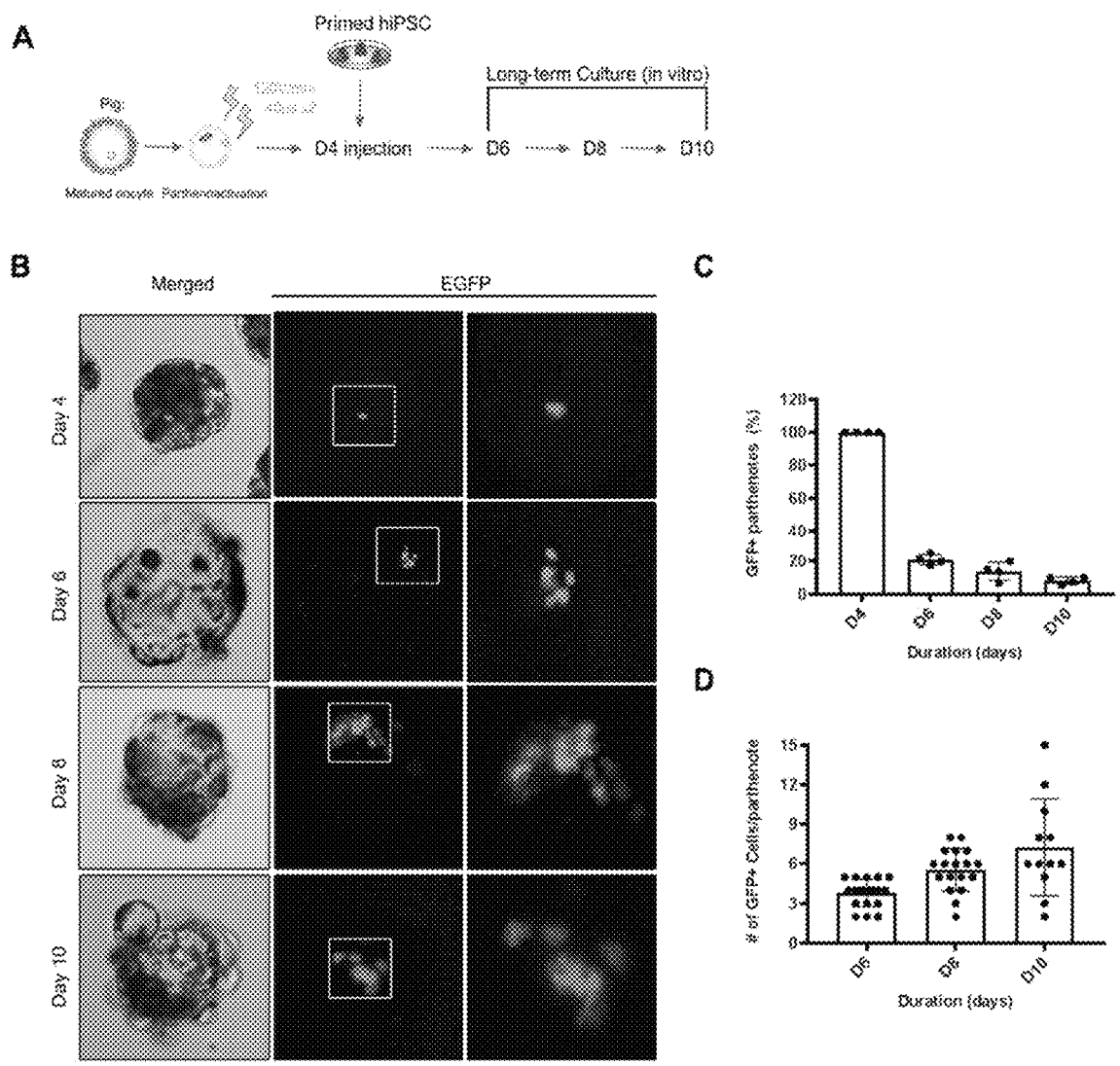
FIGS. 17A-D. GFP-labeled hiPSCs contribute to porcine embryonic chimeras in long-term cultures. A) Schematic showing the steps involved during the human-pig chimera experiment. B) Representative GFP-brightfield merged (left) and green fluorescence (right) images of the primed-hiPSCs injected into pig parthenotes at 4, 6, 8 and 10 days of their development. C) Quantitative analysis of the GFP+ parthenotes at various time periods. Quantification involved data from 4 independent experiments (30 parthenotes were analyzed at each time point). The white boxed area is magnified and shown in the right panel. (D) Quantitative analysis of GFP+ cells per parthenote at the indicated time points. Quantification includes data from four independent experiments.

Nuclear GFP-labeled hiPSC was utilized to monitor whether the hiPSC cells were able to survive, proliferate and migrate in the porcine embryo. Two primed hiPSCs were injected into the decompacted pig morulae and the cells were followed at multiple time points (FIG. 17). Similar to the pig-pig complementation studies, the analysis was restricted to healthy and developing parthenotes. As compared to pig-pig injection experiments, it was found that ~20% of the total injected parthenotes contained GFP$^+$ cells at 48 h (2 days). The numbers of GFP$^+$ parthenotes were subsequently decreased to 10% and 5% at 96 h (4 days) and 144 h (6 days) respectively, post-injection (FIG. 16). Next, quantitative analysis of GFP cells revealed ~2-fold increase in the number of green cells 48 h. The GFP$^+$ cells were increased further by 3-4-fold at 96 h and 144 h time points, indicating the hiPSCs were able to survive and proliferate in the developing pig embryo (FIG. 17). Analysis of GFP$^+$ cell localization revealed that these cells migrated to the distinct region of the developing parthenotes such as the ICM and trophoectodermal layer. These studies are the first to describe long-term culture conditions of chimeric (hiPSC in the pig parthenotes) embryos (FIG. 17).

Sequences

Span of DNA length: Human TP53 (Gene ID: 7157)
Location: chromosome: 17 Exon count 12; Range: 5001..24149 (19149 bp)
>NG_017013.2:5001-24149 Homo sapiens tumor protein p53 (TP53), RefSeqGene
(LRG_321) on chromosome 17

```
GATGGGATTGGGGTTTTCCCCTCCCATGTGCTCAAGACTGGCGCTAAAAGTTTTGAGCTTCTCAAAAGTC
TAGAGCCACCGTCCAGGGAGCAGGTAGCTGCTGGGCTCCGGGGACACTTTGCGTTCGGGCTGGGAGCGTG
CTTTCCACGACGGTGACACGCTTCCCTGGATTGGGTAAGCTCCTGACTGAACTTGATGAGTCCTCTCTGA
GTCACGGGCTCTCGGCTCCGTGTATTTTCAGCTCGGGAAAATCGCTGGGGCTGGGGGTGGGGCAGTGGGG
ACTTAGCGAGTTTGGGGGTGAGTGGGATGGAAGCTTGGCTAGAGGGATCATCATAGGAGTTGCATTGTTG
GGAGACCTGGGTGTAGATGATGGGGATGTTAGGACCATCCGAACTCAAAGTTGAACGCCTAGGCAGAGGA
GTGGAGCTTTGGGGAACCTTGAGCCGGCCTAAAGCGTACTTCTTTGCACATCCACCCGGTGCTGGGCGTA
GGGAATCCCTGAAATAAAAGATGCACAAAGCATTGAGGTCTGAGACTTTTGGATCTCGAAACATTGAGAA
CTCATAGCTGTATATTTTAGAGCCCATGGCATCCTAGTGAAAACTGGGGCTCCATTCCGAAATGATCATT
TGGGGGTGATCCGGGGAGCCCAAGCTGCTAAGGTCCCACAACTTCCGGACCTTTGTCCTTCCTGGAGCGA
TCTTTCCAGGCAGCCCCCGGCTCCGCTAGATGGAGAAAATCCAATTGAAGGCTGTCAGTCGTGGAAGTGA
GAAGTGCTAAACCAGGGGTTTGCCCGCCAGGCCGAGGAGGACCGTCGCAATCTGAGAGGCCCGGCAGCCC
TGTTATTGTTTGGCTCCACATTTACATTTCTGCCTCTTGCAGCAGCATTTCCGGTTTCTTTTTGCCGGAG
CAGCTCACTATTCACCCGATGAGAGGGGAGGAGAGAGAGAGAAAATGTCCTTTAGGCCGGTTCCTCTTAC
TTGGCAGAGGGAGGCTGCTATTCTCCGCCTGCATTTCTTTTTCTGGATTACTTAGTTATGGCCTTTGCAA
AGGCAGGGGTATTTGTTTTGATGCAAACCTCAATCCCTCCCCTTCTTTGAATGGTGTGCCCCACCCCGCG
GGTCGCCTGCAACCTAGGCGGACGCTACCATGGCGTGAGACAGGGAGGGAAAGAAGTGTGCAGAAGGCAA
GCCCGGAGGTATTTTCAAGAATGAGTATATCTCATCTTCCCGGAGGAAAAAAAAAAAAGAATGGGTACGTC
TGAGAATCAAATTTTGAAAGAGTGCAATGATGGGTCGTTTGATAATTTGTCGGAAAAACAATCTACCTGT
TATCTAGCTTTGGGCTAGGCCATTCCAGTTCCAGACGCAGGCTGAACGTCGTGAAGCGGAAGGGGCGGGC
CCGCAGGCGTCCGTGTGGTCCTCCGTGCAGCCCTCCGGCCCGAGCCGGTTCTTCCTGGTAGGAGGCGGAA
CTCGAATTCATTTCTCCCGCTGCCCCATCTCTTAGCTCGCGGTTGTTTCATTCCGCAGTTTCTTCCCATG
CACCTGCCGCGTACCGGCCACTTTGTGCCGTACTTACGTCATCTTTTTCCTAAATCGAGGTGGCATTTAC
ACACAGCGCCAGTGCACACAGCAAGTGCACAGGAAGATGAGTTTTGGCCCCTAACCGCTCCGTGATGCCT
ACCAAGTCACAGACCCTTTTCATCGTCCCAGAAACGTTTCATCACGTCTCTTCCCAGTCGATTCCCGACC
CCACCTTTATTTTGATCTCCATAACCATTTTGCCTGTTGGAGAACTTCATATAGAATGGAATCAGGCTGG
GCGCTGTGGCTCACGCCTGCACTTTGGGAGGCCGAGGCGGGCGGATTACTTGAGGATAGGAGTTCCAGAC
CAGCGTGGCCAACGTGGTGAATCCCCGTCTCTACTAAAAAATACAAAAATTAGCTGGGCGTGGTGGGTGC
CTGTAATCCCAGCTATTCGGGAGGGTGAGGCAGGAGAATCGCTTGAACCCGGGAGGCAGAGGTTGCAGTG
AGCCAAGATCGTGCCACTACACTCCAGCCTGGGCGACAAGAACGAAACTCCGTCTCAAAAAAAAGGGGGG
AATCATACATTATGTGCTCATTTTTGTCGGGCTTCTGTCCTTCAATGTACTGTCTGACATTCGTTCATGT
TGTATATATCAGTATTTTGCTCCTTTTCATTTAGTATAGTCCATCGATTGTATATCCGTCCTTTTGATGG
CCTTTTGAGTTGTTTCCCATTTGCGGTTATGAAATAAAGCTGCTATAAACATTCTTGTACAATTCTTTTT
GTGATCATATGTTTTCGTGTTTCTTGGAGAAATACTTAGGAGGGGAATTGCGAGTTTGGAAGTAAAAAGT
AGCTGTATTTTGAACTTTTTCAGAAGCTCTGAGTTTTCCAGAGCGGTTGTACCATTTTACACTCGAACTA
GCAAGGTATGGGAGTTATTATGGTTGTGCCACAGCCTTCCGGACATTAGGTATTGTCAGTCTTTCTAATG
TGGTATATCCTTGTGGTTGTAATTTACAGTTCTCTATTGACTAAGGATGTTCAGCATTTTTTCATGTGCC
TATTGGCCATTCGTATTTTGTTTGTAAAGTAGCTCTTCGAGTCTTTTACCTGTTATTTTGGTTTTTTGTT
TGTTTTTATTGTTCAGTTGTGGGACTGCTTTATACATTCTGGATACAAGTCCTTTATCAGATCCATGTGT
CGTGAATGTTTTCTTCTGATCTGTTGCTTGCCTATTTGTTTGCTTTACAGAGTTTACAGTATCTTAAGAG
GAGTGGATTTATCTTTTTTATGTTCAGTATTTGCCTTGTCCTGTTTAGGACATCTTTTTTTTTTTTTTTA
ACCCCAGGGTCATGAAGATATTATCTTACATTTTCTTTTAGGACCTTTATGGTTGTAAGTTTTACAGTAA
```

| Sequences |
| --- |
| GGTCCTTGAGCCATTAATTAATTCTTAAAATTAATTGTTTATGGTGTGAGGTGTAGGAGTCAGTCTCTGG |
| TATCTTTCCTGTATGGAAATCCAGTTATTCTGTCTCCACTTGTTGAAATAGGCTTCCTTTCTCTACTGAA |
| TGCTTTTAATTTTAATTATTTTACAGTTGGAGTATAGGGCTACCATTTTAGTGCTATTTTCTTTTTTTCT |
| TTGTTAATTTTTGAGACAGGGACTCACACTGTTGCCCAGGCTAGAGTACAATGGCACAATCAAGGCTTAC |
| TGCAGCCTCGAACCCCTGGGCTCAAGCAGTCCTCTAGGAGCCTCACGAGTAGCTGGGATTACTCCACCAC |
| ACCCAGCTAACTATTTTATTTTTTTGTATTGACAGGATCTCACTATGTTGCCCAGGCTGGTCTCAAACTG |
| CTGGCCTCAAGCTTTCATCCCATCTCGGCCTCCCAAAGTGCTGGGATTACAGGTGTGAGCCACCATGCCT |
| GACCTCTTAGTGCTATTTTCTATTTATCTCCTCTGTTCTCTGCTCTCTTTAAACGTTGGAGGAAGAAACA |
| GTACCCATCTTACACAAACTCTTCAGAAAACAGAGGAACAGACTGGGCGCGGTGGCTCATACCTGTAATC |
| TCAGCACTTTGGTACGCTGAGGCAGGGGATCATTTGAGGTCGGGAGTTCGAGACCAGCCTGGCCAACACG |
| GCGAAACCCCATCTCTACTAAAAATACAAAAAGTAGCTAGGCGTGGTGACACATACCTGTAATGCCAGTT |
| ACTCAGGAGGCTGAGGCACAAGAATCCCTTGAACCTGGGAAGCGGAGGTTGCAGTGAGCCGAGATTGCGC |
| CACTGCACTCCAGCCTGGGCAACAGAGTGAGACCCTGTCTCAGAAAAAAAAGAAAGAAAGAAAAAATAG |
| AGGAATATTTCCCAACTTGTTTTCGAAGCCAGCATAATCCTGGTACCAAAACCAAACAAGGACATTATAA |
| GAAAAGAAAATATAGACCAATATTCCTGTTAGCATAGACATGCAACAGCTAACCAATTTTAGCAAACCAA |
| ACCTGGTAATATAGAAAAAAGGATAAATAGGCCAGTCGCGGTGGCTCACGCCTGTAATCCCAGCACTTTG |
| GGAGGCTGAGGCAGGCAGATCACTTGAGGTCAGGAGTTTGAGACCAGCCTGACCAACATGGTGAAACCCC |
| GTTTCTAATAAAAATACAAAAATCAGGCTGGGCACGGTGGCTCACGCCTGTAATCCCAGCACTTTGGGAG |
| GCCGAGGTGGGCAGATCACGAGGTCAGGAGTTCAAGACCAGCCTGACCAATGTGGTGAAACGCCATCTCT |
| ACTAAAAATACAAAAATCAGCCGGTGTGGTGGCACCTGCCTGTAATCCCAGCTACTCAGGAGGCTGAGGC |
| AGAATTGCTTGAACCCGGGAGGCAGAGGTTGCAGTGAGCCAAGATCGTGCCACTGCACTCCAGCCTGGGC |
| GACAGAGCAAGACTTCATCTCAAAAAAAAAAAAAAAATTAGCTGGGCATGGTGGTGGGCACCTGAAATCCC |
| AGCTACTCGGGAGTCTGAGGCAGGAGAATCGCTTGAACCCAGGAGGCAGAAGTTGCACTGAGCTGGGATC |
| ACACCATTGCACTCCAGCCTGGGCAACAGAGTGAGACTCCATCTCAAAAAAAGAAAAAGAAAAAGGATAA |
| ATACATTCTAACCAAATAATGTTTATCTCATGATTGTAGCTGATTCAACATTCAAAAATTGGCCTGGTGC |
| AGTAGCTCAGGCCTGTAATCCCAACATTTTAGGAGGCTGAGGCAGGAAGATCTCTTGAGCCCAGGATTTC |
| AAGACCAGCCTGGGCAACATAGTCAGACTGGTCTTTACTGGGGGAAAAAAATCAGTCTGTGTAATTCAC |
| CACATTAACAAAGGGAAACATAAAAACCCTATGATCATTTCAACAGATGTAGCAAAAGCAGTTAATGATA |
| TTCAACACATATGCATGATTACAAACCAACCAACCTCCTAGCAAATAGGGAAAGGAAACTTAACCTAGT |
| TTGATAACAGGGCGTCCACAGTCGGAGTTCCACTAGCAGCATACATAATGGTAGAAAACTCAGTGCTGCC |
| GGGCGCGGTGGCTCACGCCTGTAATGCCAGCACTTTGGGAGGCCTAGGCGGGCGGATCACGAGGTCAGGA |
| GATCGAGACTGTCCTGACTAGCATGCTGAAACCCGTCTCTACTAAAAATACAAAAACAAAAAATTAGCC |
| GGGCATGGTGGCGGGCGCCTATAGTCCCAGCTACTCGGGAGGCTGAGGCGAGAGAATGGCGTGAACCCGG |
| GAGGCGGAGCTTGCAGAGCCTAGATCGTGCCACTGCACTCCAGCCTGGGTGACAGAGTGAGACTTCGTCT |
| CAAAAAAAAAAAAAAAAAAAAAAAGAAAAGAAAACTCAACGCTTTTTCCTCTAAGATCAGGAACTAGAAAA |
| GGATTTGACTCTCACAACGTTGATACCATACTGGAGGTTTTAACCAGGCAAGAAAAAGAAATAATGAGGG |
| CCGGGTGCGGTGGCTCAGGCCTGTAATCCCAGCACTTTGGGAAGCCGAGACGGGTGGATCACGAGGTCAG |
| GAGATCGAGACCATCCTGGCTAACACGGTGAAACCCTGTCTCTACTAAATATACAAAAAATTAGCCGGGC |
| GTAGTGGCGGGCGCCTGTAGTCCCAGCTACTCGGGAGGCTGAGGCAGGAGAATGGCGTGAACTCAGGGGG |
| CGGAGCTTGCAGTGAGCCGAGATCGAGCCACTGCACTCCAGCCTGGGCGACAGAGCAAGACTGTGTCTCA |
| AAAAAAAAAAAGAAAAAGAAATAATGATTAGTGGCCCGATGTCTCACGCCTATAATCCCAGCACTTTGG |
| GAGGCCGAGGTGGGCAGATCACCTGAGGTCTGGAGTTGGAGACCAGCCTGACAAAGATGGTGAAACCTCG |
| TCTCTATTAAAATATTAAAAAAATAGCCAGGCGTTGGCCGGGTACAGTGGCTCATGCCTGTAATCCCAGC |
| ACTTTGGGAGGCCGAGGTGGGTGGATCACCTGAGGTCAGGAGTTCAACACCAGCCTGGCCAACATGGTGA |
| AACCCCATCTCTACTAAAAATACAAAAATTAGCCGGGCGTAGTGGCGGGCGCCTGTAATCCCAGCTACTT |
| GGGAGGCTTAGGCAGGAGAATCGCTTGAACCTGGGAGGCGGAGGTTGTAGTGAGCCGAGATTGCACCATT |
| GCACTCCAGCCTGGGTGACAAAAGCAAAACTCCGTCTCAAAAAAAAAAGAATTAGCCAGGGTAGTGGT |
| GAACGCCTGTAGTCCCAGCTACTCAGGAGGCAGAGGCAGGAGAATCACTTGAACCCAGGAGGCAGAGGTT |
| GCAGTGAGCCGAGATTGTCCCATTGCACTCCAGCCTAGGCGACAAGAGCAAATTCCATGTCAAAAAAAA |
| AAAAAAAAAAGGAAAGAAAAAAAATAACGATTAGAAAGGAAGAAATAAAACACATTCACAGCCAGTATGA |
| TTCTATACATACATGTCCTAATGGGGCCAGGCGTGGTGGCTCATGCCTGTAATCCTAGCACTTTTAGGAG |
| GCTGAGGCAGGTGGCTTCCCTGGGACCAGCCTGGCCAACATGGTGAAACCCCAACTCTAATAAAAATACA |
| AAAAATCAGCCAGGCGTGGTGACGGGCACCTCTAATCCCAGCTGGGAGGCTGAGGCAGGAGAATTG |
| CTTGGACCTGGGAGGCAGAGGTTGCAGTGAGCCGAGATCGCGCTATTGCACTCCAGCCTGGGCAACAAGA |
| GTGAAACTCCGGCAGGGTGTGGTGGCTTACGCCTGTAATCCCAGCACTTCGGGAGGCTGAGGCAGGCCGA |
| TCACCTGAGGTCAGGAGTTTGAGACCAACCTAACATGGTGAAACCCCGTCTCTACTAAAAATACAAGAAT |
| TAGCTGGGTGTAGTGGTGGGCGCCTGTAATCCCAGCTACTGGGAGGCTGAGCAGAGGAATTGCTTGAA |
| CCCAGGAGGTGGAGGTTGCAGTGAGCTGAGATCATGCCATTGCACACCACGCCGGGCAACAGAGCGAGAT |
| TCCGTCTCAAAAAAAAAAAAAAAAGAGTGAAACTCTATCTCAAAAAAAAAAAAAGTCCTAATGGAAATC |
| CATAAAAAGCTACCAAAACTAATAAATAAATATAGCAGGGTTGCAGGTTACAGGGCAATATAGTTATCCC |
| TCTATCTGTAGGGGCTTGGTTCTGGGACTCCTCACACACCAAACCCACAGATGTCTAAGTCCCATATATA |
| AGACGGTATAGTATTTGGATTTAACCTACACATATCCTCCCATATAGTTTAAATTATCTCTAGATTACTT |
| ACATTACCCCCATACAATGAAAATGCTAATGTACATGCAAGTATGTATGTAAGTACTTGTACTATATTGT |
| TTAGGGAATCACTGGACATATAGGCCTTCAAGACTGATACCAGCAGCCACTGTTAAGATTCTGGTCAGGC |
| CTGCCCCTGTTTGGGGTCTCAGTTGATCTCATTGCCTTCCCACCCAGCCAAGGGCACCTGCATTTCTCTT |
| GGCTCCCTGGCCATTTGGAAGGCCTAGTTCAGCCTGGCACATTTGTATCCTGGCCCACTGATGCTGGTAC |
| CCCTGGGAAGGTCCTGCTCTGAAAAACACGGAGATTTTAGTTGCTACTGAAGATTTGAGAGATAAAGACA |
| GGGAGACCTGTCTGTAGACCTGTGTCCCTCCAAGTGGGATTGAGACTTTGGGCCCCCCATTTCAGGACAG |
| CACCTCCTGGCCTGTTGACTGAATAGATCCCTGAAGGAGGTGTACTTGCATTAATGGAGTGGGGGTGGGA |
| GCAGTACCACAGATCCGCACTAACAATCACACAGTTCTCTCTAGAATAATAATATAGAACAAGTGAAATA |
| GAACAATTGCAGAAAGAGCTAACCTTTGTTGAGCTCTTACTGTCTGTGCCCAGCACTTTCCTCAACTCTACA |
| TTTCCCATAATACACAGAGTACTAGGTAGGCCAGGCTTGGTGCTCACGCCTGTAATCCCAGCACTTTAG |
| GAGGCCAAGGGGGTGGATCACCTGAGGTCGGGAGTTCAAGACGAGCCTGACCAACATGGTGAAACCCCG |
| TCTCTACTAGAAGTACAAAATTAGCCAGGTGTGGTGGCACATGCTTGTAGTCCTAGCTACTCAGCAGGCT |
| GAGGCAGGAGAATCATTTGAATCCGGGAGGAGGTTGCAGTAAGCGGAGATAGTGCCACTGTACTCCAGCC |
| TGGGCAATAAGAGCTGAGACTCCGTCTCAAAATAAAATAAAATAAAATAAAATAAAATAAAATAA |
| AAAAAGAAAAGAGCCTGCCATTAAAGGAGCTGTTTGGTAGGGGATGTTTGTCAGTGCAAACAACAGAAA |

| Sequences |
| --- |
| AGTGGGCTGGGCACAGTGGTTCATGCCTGTAATCCCAGCACTTTGGGAGGCCAAGGCGGGCGGATCACCT |
| GAAGTTGGGAGTTCAAGACCAGCCTGACCAATATGGAGAAACCCCGTCTCTACTAAAAATACAAAATTAG |
| CCGGGCGGAGTGGCGCATGCCTGTAATCCCAGCTACTCGGGAGGCTGAGGCAGGAGAATCGCTTGAACCT |
| GGGAGGCAGAGGTTGCGGTGAGCCGAGATCGCACCATTGCACTCCAGCCTGGACGAGAGCAAAACTCTGT |
| CTCAAAAAAAAAAAAAAACAGAAAGTGTAACAAACACTTACAGTAGGCATGTTTCTTAGCAAATCTGAT |
| GACAAATTTGGCATAAAGAAAGAGAGCATCCCTGAAAAAAAAAAAAAGAAAAAGAAAGAGAGCATCCTGC |
| CTGGGCAACATAGTGAAACCCTGCCTCTACAAAAAAACTCAAAAATTGGCCGGGTGCAGTGGCTCACACC |
| TGTAATCCCAGCACTTTGGGAGTCGGAGGCGGGAGGATCACCTGAGGTCAGGAGTTCGAAACCAGCCTGG |
| CCAACATGGCAAAACCCCATCTCTACTAAAAATACAAAAAATTAATCAGGCGCATTGGTGGGCGCCTGTA |
| ATCCCAGCTACTCAGGAAGTTGAGGCAAGAGGATCGCTTGAATCTGGGAGGTGGAGGTTACAGTGAGTCG |
| AGATCACACCACTGCACTCTAGCCTGGGTGACAGGGCGAGACTCCGTCTCCAAAAAAAAAAAGAAAAAGA |
| AAAAGACTAAAAAATTAGCCAGGCAGGCCTCTGTGGTCCCAGCTACTTGGGAGGCTGAGGCAGGAGAATC |
| ACTGAGCCCAGGAGTCCGAGGCTGTAGTGAGCCATGATTGCACCACTGTACCCTAGCTTGGGCAACAAAG |
| CAAGACCCTGCCTCAAAAGAAAAAGAAAGAAAGAAGAACATGGCGGGCCAGGCACAGTGGCTCACACC |
| TGTAATCCCAGCGCTTTGAGAGGCCGAGGCAGGTGGATCACAAGGTCAGGAGTTCCACACCAGCCTGGCC |
| AACATGGTGAAACCCTGTCTCTACTAAAAATACAAAAAATCAGCCAGGCATGGTGGCAGGGGCCTGTAAT |
| CCCAGCTACTCGGGAGGCTGAGGCAGGAGAATTGCTTGAAACCAGAAGGCAGAGGTTGCAGTGAGCCTAG |
| ACTGCACCACTGCACTCCAGCCTGGGCGAAAAGAGCCAAACTCCATCTCAAAAAACAAACAAAAAAACAA |
| AACAAAAGAAAACATGGCAAAGCCTTTGAAAGCTTGTCTGGGAGAAGGTGCGATGATAGTTGCATAACTT |
| CGTGCAAGATGCTGGTCCACACAGGGGCTGCCCCTTGCTCTTTCTCGCTCTCTTAACCTCTCATATAACA |
| GGCTTGTGTGTTATTCACATTTATTGAGCCCAAGCAGGTGCAAGGCATTGTGATCTAATACTTTGGTCAG |
| CAAGACAACAAGATAGATCACTGCCCTGCCCTTAGGAAGTGTATATGCTATTAGAGGAAACAGATAAAAT |
| AAACAAGGAAAAGTATCAGACAATGTAAGTGCTATGAGAATGCAAATGAGGTGATGTGAATTAAAATAGG |
| ATGACTTAAAGTCTGCACGGGAAGGAGCCTACCCCCATGTTCCTGGCTAGCCAAGGAACCACCAGTTGAT |
| TAGCAGAGAAGGGCAGCCAGTCTAGCTAGAGCTTTTGGGGAAGAGGGAGTGGTTGTTAAGAGATGAGATT |
| AAAGAAGCCGAGACGGGCCATTCGTGAGGGGTTTGTAATGCAGGGCTGAGGAGTGTCCGAAGAGAATGGG |
| CAGGTGAGCGGTGAGACAGTTGTTCTTCCAGAAGCTTTGCAGTGAAAGGAATCAAAGAAATGGAGCCGTG |
| TATCAGGTGGGGAAGGGTGGGGGCCAAGGGGGTGTCCTTCCCCATACAGAGATTGCAGGCTGAGAATGAC |
| TATATCCTTGTTAACAGGAGGTGGGAGCAGGGCACGGTAGCTCACACCTGTAATCTTGGCACTTTAGGAG |
| GCTGAGGCGGGCCGATCACCTGAAGTAAGGAGTTCGAGACCAGCCTGGCCAACATGCAAAGCCCTGTCTC |
| TACTAAAAATACAAAATTAGCTGGGTGTGGTGGTACTCGCCTGTAATCCCAGCTACTCGGGAGACTGAG |
| GCAGGAGAATGGCTTGAACCCGGAAGGTAGAGGTTGCAGTGAGCTGAGATCATGCCATGCTGTGCTCCAGCC |
| TAGGTGACAGAGAGAGACTCCATCTCAAAAAAAAAAAAAAAAATACAGGAAGGAGTTGGGAATAGGGTGC |
| ACATTTAGGAAGTCTTGGGGATTTAGTGGTGGGAAGGTTGGAAGTCCCTCTCTGATTGTCTTTTCCTCAA |
| AGAAGTGGATGGCTGGTGAGGGGTGGGCAGGAGTGCTTGGGTTGTGGTGAAACATTGGAAGAGAGAATG |
| TGAAGCAGCCATTCTTTTCCTGCTCCACAGGAAGCCGAGCTGTCCCCCCTCCTGCTGTCATCTGGCATGGTGTTGGGGGA |
| GGGGGTTCCTTCTCTGCAGGCCCAGGTGACCCAGGGTTGGAAGTGTCTCATGCTGGATCCCCACTTTTCC |
| TCTTGCAGCAGCCAGACTGCCTTCCGGGTCACTGCCATGGAGGAGCCGCAGTCAGATCCTAGCGTCGAGC |
| CCCCTCTGAGTCAGGAAACATTTTCAGACCTATGGAAACTGTGAGTGGATCCATTGGAAGGGCAGGCCCA |
| CCACCCCCACCCCAACCCCAGCCCCCTAGCAGAGACCTGTGGGAAGCGAAAATTCCATGGGACTGACTTT |
| CTGCTCTTGTCTTTCAGACTTCCTGAAAACAACGTTCTGGTAAGGACAAGGGTTGGGCTGGGAGACCTGGA |
| GGGCTGGGGACCTGGAGGGCTGGGGGCTGGGGGCTGAGGACCTGGTCCTCTGACTGCTCTTTTCACCC |
| ATCTACAGTCCCCCTTGCCGTCCCAAGCAATGGATGATTTGATGCTGTCCCCGGACGATATTGAACAATG |
| GTTCACTGAAGACCCAGGTCCAGATGAAGCTCCCAGAATGCCAGAGGCTGCTCCCCCCGTGGCCCCTGCA |
| CCAGCAGCTCCTACACCGGCGGCCCCTGCACCAGCCCCCTCCTGGCCCCTGTCATCTTCTGTCCCTTCCC |
| AGAAAACCTACCAGGGCAGCTACGGTTTCCGTCTGGGCTTCTTGCATTCGGGACAGCGAAGTCTGTGAC |
| TTGCACGGTCAGTTGCCCTGAGGGGCTGGCTTCCATGAGACTTCAATGCCTGGCCGTATCCCCTGCATT |
| TCTTTTGTTTGGAACTTTGGGATTCCTCTTCACCCTTTGGCTTCCTGTCAGTGTTTTTTATAGTTTACC |
| CACTTAATGTGTGATCTCTGACTCCTGTCCCAAAGTTGAATATTCCCCCCTTGAATTTGGGCTTTTATCC |
| ATCCCATCACACCCTCAGCATCTCTCCTGGGGATGCAGAACTTTTCTTTTTCTTCATCCACGTGTATTCC |
| TTGGCTTTTGAAAATAAGCTCCTGACCAGGCTTGGTGGCTCACACCTGCAATCCCAGCACTCTCAAAGAG |
| GCCAAGGCAGGCAGATCACCTGAGCCCAGGAGTTCAAGACCAGCTGGGTAACATGATGAAACCTCGTCT |
| CTACAAAAAATACAAAAAATTAGCCAGGCATGGTGGTGCACACCTATAGTCCCAGCACTTAGGAGGCT |
| GAGGTGGGAAGATCACTTGAGGCCAGGAGATGGAGGCTGCAGTGAGCTGTGATCACACCACTGTGCTCCA |
| GCCTGAGTGACAGAGCAAGACCCTATCTCAAAAAAAAAAAAAAAGAAAAGCTCCTGAGGTGTAGACG |
| CCAACTCTCTCTAGCTCGCTAGTGGGTTGCAGGAGGTGCTTACGCATGTTTGTTTCTTTGCTGCCGTCTT |
| CCAGTTGCTTTATCTGTTCACTTGTGCCCTGACTTTCAACTCTGTCTCCTTCCTCTTCCTACAGTACTCC |
| CCTGCCCTCAACAAGATGTTTTGCCAACTGGCCAAGACCTGCCCTGTGCAGCTGTGGGTTGATTCCACAC |
| CCCCGCCCGGCACCCGCGTCCGCGCCATGGCCATCTACAAGCAGTCACAGCACATGACGGAGGTTGTGAG |
| GCGCTGCCCCCACCATGAGCGCTGCTCAGATAGCGATGGTGAGCAGCTGGGGCTGGAGAGACGACAGGGC |
| TGGTTGCCCAGGGTCCCCAGGCCTCTGATTCCTCACTGATTGCTCTTAGGTCTGGCCCCTCCTCAGCATC |
| TTATCCGAGTGGAAGGAAATTTGCGTGTGGAGTATTGGATGGACAGAAACACTTTTCGACATAGTGTGGT |
| GGTGCCCTATGAGCCGCCTGAGGTCTGGTTTGCAACTGGGGTCTCTGGGAGGAGGGGTTAAGGGTGGTTG |
| TCAGTGGCCCTCCAGGTGAGCAGTAGGGGGGCTTTCTCCTGCTGCTTATTTGACCTCCCTATAACCCCAT |
| GAGATGTGCAAAGTAAATGGGTTTAACTATTGCACAGTTGAAAAAACTGAAGCTTACAGAGGCTAAGGGC |
| CTCCCCTGCTTGGCTGGGCGCAGTGGCTCATGCCTGTAATCCCAGCACTTTGGGAGGCCAAGGCAGGCGG |
| ATCACGAGGTTGGGAGATCGAGACCATCCTGGCTAACGGTGAAACCCCGTCTCTACTGAAAATACAAAA |
| AAAATTAGCCGGGCGTGGTGCTGGGCACCTGTAGTCCCAGCTACTCGGGAGGCTGAGGAAGGAGAATGG |
| CGTGAACCTGGGCGGTGGAGCTTGCAGTGAGCTGAGATCACGCCACTGCACTCCAGCCTGGGCGACAGAG |
| CGAGATTCCATCTCAAAAAAAAAAAAAAAAGGCCTCCCCTGCTTGCCACAGGTCTCCCCAAGGCGCACTG |
| GCCTCATCTTGGGCCTGTGTTATCTCCTAGGTTGGCTCTGACTGTACCACCATCCACTACAACTACATGT |
| GTAACAGTTCCTGCATGGGCGGCATGAACCGGAGGCCCATCCTCACCATCATCACACTGGAAGACTCCAG |
| GTCAGGAGCCACTTGCCACCCTGCACACTGGCCTGCTGTGCCCCAGCCTCTGCTTGCCTCTGACCCCTGG |
| GCCCACCTCTTACCGATTTCTTCCATACTACTACCCATCCACCTCTCATCACATCCCCGGCGGGAATCT |
| TACCTGGAGCTGGAGCTTAGGCTCCAGAAAGGACAAGGGTGGTTGGGAGTAGATGGAGCCTGGTTTTTTA |
| AATGGGACAGGTAGGACCTGATTTCCTTACTGCCTCTTGCTTCTCTTTTCCTATCCTGAGTAGTGGTAAT |
| CTACTGGGACGGAACAGCTTTGAGGTGCGTGTTTGTGCCTGTCCTGGGAGAGACCGGCGCACAGAGGAAG |

-continued

| Sequences |
|---|
| AGAATCTCCGCAAGAAAGGGGAGCCTCACCACGAGCTGCCCCCAGGGAGCACTAAGCGAGGTAAGCAAGC |
| AGGACAAGAAGCGGTGGAGGAGACCAAGGGTGCAGTTATGCCTCAGATTCACTTTTATCACCTTTCCTTG |
| CCTCTTTCCTAGCACTGCCCAACAACACCAGCTCCTCTCCCCGACCAAAGAAGAAACCACTGGATGGAGA |
| ATATTTCACCCTTCAGGTACTAAGTCTTGGGACCTCTTATCAAGTGGAAAGTTTCCAGTCTAACACTCAA |
| AATGCCGTTTTCTTCTTGACTGTTTTACCTGCAATTGGGGCATTTGCCATCAGGGGGCAGTGATGCCTCA |
| AAGACAATGGCTCCTGGTTGTAGCTAACTAACTTCAGAACACCAACTTATACCATAATATATATTTTAAA |
| GGACCAGACCAGCTTTCAAAAAGAAAATTGTTAAAGAGAGCATGAAAATGGTTCTATGACTTTGCCTGAT |
| ACAGATGCTACTTGACTTACGATGGTGTTACTTCCTGATAAACTCGTCGTAAGTTGAAAATATTGTAAGT |
| TGAAAATGGATTTAATACACCTAATCTAAGGAACATCATAGCTTAGCCTAGCCTGCTTTTTTTTTTTTTT |
| TTTTTGGAGACAGAGTCTCACTCTGTCACCCAGGCTGGAGTGCAGTGGCGGGATCTCGGCTCACTGCAAC |
| CTCCGCCTTCTGGGTTCAAGCGATTCTCCTGCCTCAGCCCACTGAGTAGCTGGGATTACAGGCACCTGCC |
| CCGACGCCCAGCTAATTTTTTGTTATTTATTTATTTTTTTTTTAGTAGAGATGAGGTTTCACCATGTTG |
| GCCAGGCTAGTCTCGAACTCCTGACCTTGTGATCTGCCTGCCTTGGCCTCCCAAAGTGCTGGGATTACAG |
| GCGTGAGCCACCGCACCCGGCCTGCCTAGCCTACTTTTATTTTATTTTTAATGGAGACAGCATCTTGCTC |
| TGTTGCCCAGGCTGGATTACAGTGATGTGATCATAGCTCATTATCCCTCCTGGGCTCAAGCAATCCCCC |
| TAACTCTGCCTCCCCAGTAGCTAGGACCACAGGCATACACCACCATACCCAGCTAATTTTTAAAATTTTT |
| TGTAGATAGATAGAGTCTCACTATGTTGCCCAGGCTGGTCTCTAGCCTACTTTTTTGAGACAAGGTCTTG |
| CTCTGTCACCCAGGCTGGATAGAGTGCAGTAGTGCAGTCACAGCTCACTGCAGCCTCCACCTCCCAGGCT |
| CCATCCATCCTCCCAGCTCAGCCTCCCAAGTTGCTTCAACTACAGGCCTGCACCACCATGCCTGGCTAAT |
| TTTTATTTATTTATTTTATTTTATTTATTTATTTTTTGAGACACAGTCTCACTCTGTCGCCCAGGC |
| TGGAGTGCAGTGGCATGATCTCGGCTCACTGCAACCTCTGCCTCCTGGGTTCAAGTGATTCTCCTGCCTC |
| AGCCTCCCGAATAGCTAGGACTACAAGCGCCTGCTACCACGCCCAGCTAATTTTTGTATTTTTAGTAGAG |
| ACAGGGTTTCACCATGTTGGCCAGGCTGGTCTCGAACTTCTGACCATGTGATCCGCCCGCCTCGGCCTCC |
| CAAAGTGCTGGGATTACAGGTGTGAGCCACCACGCCCGGCTAATTTTTATTTTATTTTAAAGACAGAG |
| TCTCACTCTGTCACTCAGGCTAGAGTGCAGTGGCACCATCTCAGCTCACTGCAGCCTTGACCTCCCTGGG |
| CTCCGGTGATTTCACCCTCCCAAGTAGCTAGGACTACAGGCACATGCCACGAGACCCAGCTAATTTTTTA |
| TTTTTCTGTGAAGTCAAGGTCTTGCTACGTTGCCCATGCTGGTATCAAACCCCTGGGCTCAATCAATCCTT |
| CCACCTCAGCCTCCCCAAGTATTGGGGTTACAGGCATGAGCTACCACACTCAGCCCTAGCCTACTTGAAA |
| CGTGTTCAGAGCATTTAAGTTACCCTACAGTTGGGCAAAGTCATCTAACACAAAGCCCTTTTTATAGTAA |
| TAAAATGTTGTATATCTCATGTGATTTATTGAATATTGTTACTGAAAGTGAGAAACAGCATGGTTGCATG |
| AAAGGAGGCACAGTCGAGCCAGGCACAGCTGGGCGCAGAGCGAGACTCAAAAAAAGAAAAGGCCAGGCG |
| CACTGGCTCACGCCTGTAATCCCAGCATTTCGGGAGGCTGAGGCGGGTGGATCACCTGAGGTCAGGAGTT |
| CAAGACCAGCCTAGCCAACATGGTGAAACCCCGTCTCTACTAAAATACAAAAATTAACCGGGCGTGATGG |
| CAGGTGCCTGTAATCCCAGCTACTTGGGAGGCTGAGGCAGGAGAATCGCTTGAACCAGGAGGCGGAGGTT |
| GCAGGGAGCCAAGATGGCGCCACTGCACTCCAGCCTGGGCGATAGAGTGAGACTCCGTCTCAGAAAAAAA |
| AGAAAAGAAACGAGGCACAGTCGCATGCACATGTAGTCCCAGTTACTTGAGAGGCTAAGGGAGGAGGATC |
| TCTTGAGCCCAAGAGTTTGAGTCCAGCCTGAACAACATAGCAAGACATCATCTCTAAAATTTAAAAAAGG |
| GCCGGGCACAGTGGCTCACACCTGTAATCCCAGCACTTTGGGAGGTGGAGGTGGGTAGATCACCTGACGT |
| CAGGAGTTGGAAACCAGCCTGGCTAACATGGTGAAGCCCCATCTCTACTAAAAACACAAAAATTAGCCAG |
| GTGTGGTAGCACACGCCTGTAGTCCCAGCTACTCGGGAGGCTGAGGCAACAAGAATCACTTGAACCCCAGA |
| GGCGGAGATTGCAATCAGCCAAGATTGCACCATTGCACTCCCGCCTGGGCAACAGAGTGAGACCCCCATCT |
| CAAAATAAATAAATAAATATTTTTAAAAGTCAGCTGTATAGGTACTTGAAGTGCAGTTTCTACTAAATGC |
| ATGTTGCTTTTGTACCGTCATAAAGTCAAACAATTGTAACTTGAACCATCTTTTAACTCAGGTACTGTGT |
| ATATACTTACTTCTCCCCCTCCTCTGTTGCTGCAGATCCGTGGGCGTGAGCGCTTCGAGATGTTCCGAGA |
| GCTGAATGAGGCCTTGGAACTCAAGGATGCCCAGGCTGGGAAGGAGCCAGGGGGGAGCAGGGCTCACTCC |
| AGGTGAGTGACCTCAGCCCCTTCCTGGCCCTACTCCCCTGCCTTCCTAGGTTGGAAAGCCATAGGATTCC |
| ATTCTCATCCTGCCTTCATGGTCAAAGGCAGCTGACCCCATCTCATTGGGTCCGAGCCCTGCACAGACAT |
| TTTTTTAGTCTTCCTCCGGTTGAATCCTATAACCACATTCTTGCCTCAGTGTATCCACAGAACATCCAAA |
| CCCAGGGACGAGTGTGGATACTTCTTTGCCATTCTCCGCAACTCCCAGCCCAGAGCTGGAGGGTCTCAAG |
| GAGGGGCCTAATAATTGTGTAATACTGAATACAGCCAGAGTTTCAGGTCATATACTCAGCCCTGCCATGC |
| ACCGGCAGGTCCTAGGTGACCCCCGTCAAACTCAGTTTCCTTATATATAAAATGGGGTAAGGGGCCGGG |
| CGCAGTGGCTCACGAATCCCACACTCTGGGAGGCCAAGGCGAGTGGATCACCTGAGGTCGGGAGTTTGAG |
| CCCAGCCTGACCAACATGGAGAAACCCCATCTCTACTAAAAATACAAAAGTAGCCGGGCGTGGTGATGCA |
| TGCCTGTAATCCCAGCTACCTACTCGGGAGGCTGAGGCAGGAGAATCGCTTGAACCCGGGAGGCAGAGGT |
| TGCGGTGAGCTGAGATCTCACCATTACACTCCAGCCTGGGCAACAAGAGTGAAACTCCGTCTCAAAAAAG |
| ATAAATAAAGTAAAATGGGGTAAGGGAAGATTACGAGACTAATACACACTAATACTCTGAGGTGCTCAGT |
| AAACATATTTGCATGGGGTGTGGCCACCATCTTGATTTGAATTCCGTTGTCCAGCCTTAGGCCCTTCA |
| AAGCATTGGTCAGGGAAAAGGGGCACAGACCCTCTCACTCATGTGATGTCATCTCTCCTCCCTGCTTCTG |
| TCTCCTACAGCCACCTGAAGTCCAAAAAGGGTCAGTCTACCTCCCGCCATAAAAAACTCATGTTCAAGAC |
| AGAAGGGCCTGACTCAGACTGACATTCTCCACTTCTTGTTCCCCACTGACAGCCTCCCACCCCCATCTCT |
| CCCTCCCCTGCCATTTTGGGTTTTGGGTCTTTGAACCCTTGCTTGCAATAGGTGTGCGTCAGAAGCACCC |
| AGGACTTCCATTTGCTTTGTCCCGGGGCTCCACTGAACAAGTTGGCCTGCACTGGTGTTTTGTTGTGGG |
| AGGAGGATGGGGAGTAGGACATACCAGCTTAGATTTAAGGTTTTTACTGTGAGGGATGTTTGGGAGATG |
| TAAGAAATGTTCTTGCAGTTAAGGGTTAGTTTACAATCAGCCACATTCTAGGTAGGGCCCACTTCACCG |
| TACTAACCAGGGAAGCTGTCCCTCACTGTTGAATTTTCTCTAACTTCAAGGCCCATATCTGTGAAATGCT |
| GGCATTTGCACCTACCTCACAGATGCATTGTGAGGGTTAATGAAATAATGTACATCTGGCCTTGAAACC |
| ACCTTTTATTACATGGGGTCTAGAACTTGACCCCCTTGAGGGTGCTTGTTCCCTCTCCCTGTTGGTCGGT |
| GGGTTGGTAGTTTCTACAGTTGGGCAGCTGGTTAGGTAGAGGGAGTTGTCAAGTCTCTGCTGGCCCAGCC |
| AAACCCTGTCTGACAACCTCTTGGTGAACCTTAGTACCTAAAAGGAAATCTCACCCCATCCCACACCCTG |
| GAGGATTTCATCTCTTGTATATGATGATCTGGATCCACCAAGACTTGTTTTATGCTCAGGGTCAATTTCT |
| TTTTTCTTTTTTTTTTTTTTCTTTTCTTTGAGACTGGGTCTCGCTTTGTTGCCCAGGCTGGAGTG |
| GAGTGGCGTGATCTTGGCTTACTGCAGCCTTTGCCTCCCCGGCTCGAGCAGTCCTCCTGCCTCAGCCTCCGGA |
| GTAGCTGGGACCACAGGTTCATGCCACCATGGCCAGCCAACTTTTGCATGTTTTGTAGAGATGGGGTCTC |
| ACAGTGTTGCCCAGGCTGGTCTCAAACTCCTGGGCTCAGGCGATCCACCTGTCTCAGCCTCCCAGAGTGC |
| TGGGATTACAATTGTGAGCCACCACGTCCAGCTGGAAGGGTCAACATCTTTTACATTCTGCAAGCACATC |
| TGCATTTTCACCCCACCCTTCCCCTCCTTCTCCCTTTTTATATCCCATTTTTATATCGATCTCTTATTTT |
| ACAATAAAACTTTGCTGCCACCTGTGTGTCTGAGGGGTG (SEQ ID NO: 38) |

-continued

Sequences

Pig TP53 (Gene ID: 397276)
Location: chromosome: 12 Exon count: 11
Range: 52939643..52953786 complement (14144 bp)
>NC_010454.4:c52953786-52939643 Sus scrofa isolate TJ Tabasco breed Duroc
chromosome 12, Sscrofa11.1, whole genome shotgun sequence
AAAAGTCCAGGGCCACCATCCTTGGCGCAGGTAGCTGCTGGTCTCCGGGGTCACCTGACGTCCCGTCTCG
AGCGTGCATCCCAGGACAGTGACACGCTCTCCTGAGCTTCGGGTAAGCTCTTAACTGAGCCTGATGAATA
CTCTATGAGTCATGGGCTCTCGGGTCTGTGTATTTTCAGCTCAGAAGAAAGGAGGATGGAGGTGGAGCGA
AAGATTTAGTGATTTGGGGGGGGGGGAAATGGAAGTTCTTCTAGCGGCATCAACAGAGGAATGCAATG
TTGGGAGGCCTGAGTGTAGATGATAGGGATGTTAGGACCAACCGAACTAAAAAGCTGAACACCTGCGCCG
GGTAGTGGGGCTTTGGGGAAAACTTGAGCCTGCCTAAGGGGTTCTTCCCCACCACCGCCACCACCCCATT
TCAGTACCCGGTGTGGGGGAGCCCTTAATAAGACACACAAAGCATCAAGGTCCGAGGCTTTGGGATCTTG
GAACTTTGGGGATTTATGGCTCGAGATTTTAGTGCGTATGGCATCCCAGTGGAACCCTGGACTCCATTCC
GAAGTGGTTATCCGGAGTGCTCCGGGAAGTCCAAGGTGCTAACTTCCGGACCTTTGTCCTTTCTTGAGTG
AACTTTCCAACTGGCCTTCAGCGCCTCAGGATGGAGAAAGTCCATTTAAAGGCTGTCAGTTGTGGAAATG
GGACATGCTAAACAAGAGGTTTGCCCGCGAAGCCTCGGAGGAGTAACCCGGCCGGAGAGGCCCGGGAGCC
CTGTTATTGTTTGGCTCTGCATTTACATTTCTGCCACTCGCAGGAGCATTTCCGGTTTCTTTTCTTCGGA
ACAGCCCACTATTCACCCGATGTGAGGGAAGTAGAAAGAGAAAAGGTCTTTTAAACTGGTTCCTATTGCT
TGCTGCAAGGGGCTGTTAACCCCCTCTACCTTTTTTTTGTCCTTCATGGACTACTTAGCCACCGCTTTTG
GGAAGGAAAAAGCATTTGTTATGATGCAAACCTCAGTCCCTCCCCCTCTTGTGAATGGTGTGCTCCTTCC
TGGTTGTCTGCTAACCAGGCGGACGCTACCATTGCCTGGGGCGGTTTTCTTTTCTTTAAATATCAGAAGG
CAAACCTTGGGTATCTTCGAGAATGGGTACATCTGAGATTTAAACGATAAAAAAGCATAACGATGGGGTT
GTTTGTTTGTGGCAGAGAAACAATTTCTTCTGTATCCGGCTTTGGGCTGAGCCATCCCCATTTTCGGACG
CAGAATGAACGTCGTGAAAGCGGAAGGGGCGGGGCTTGGAGAGGGGCGGGGACGGAGCTTCCCAAGTGCAG
CCCTCCGGTCCCGGCTAGTTCTCGCCTGCGGGAGGCGGCTTGACCCCGCGCGGAGTCCGTCGAATGCTCT
CCTGGGGCATCTTCACCATTTAGGGCGCGGTCGCCTACCTCGCACCTGCTGCGAATCAGACTCTGTGGGC
GGTACTTACGCGCTTTTTTTCTAAATCGAGGTAGCATTTACACTCACCTCCTATCAAAATACAAGTCTCA
TGCTTCTTTCCAGTTTATCTTTAACCCTCCACCTTCATTTTGATTTCTGTCCTCATGGAATAGTTTTGCC
TGTTGGAGAACTGCTTTATAAATGGAATCATACAGGTCGTGCTCGTTTGTGTCAGACTTCTTTCCTTCAG
CAAAATCTTTGTAATGCACCCATTTTATTGCATGTGTCAGTGGTGTATCAGTATCTTGCTCCTTTTCATT
TAATGTGTTGCACTGGATGAATAAACCATCCATTGTTTATCCATTCTCCTCGTGGTGGCCTTTTGAGTTG
TTTCCTGTTTGGGATTAGTTTTAATAAAGCTGCTCTTGACATTCTTGTACAGTTCTTTTTGTGGTCATAT
GTTTTTATGTTTCTTGGATATATACTTAGGAGTAGAATTACTAAGTCATAGAGTAGGGAATACATCTATG
CGTTTTTAAATTTTATTTAAAAATTCTGAAGTTCCCACTGTGGCACACAGGGTTAAGGACCTGGTGTCTC
TGCAGCAGCTCAAGTGGCTGTTGTGGTGCAAGTTCCATCCACGCCTGGCTCAGTGGGTTAAGGATCTTAC
CCGGGAACTTCCATGTGCCACAGGTGCGACCATACAAAAAATTTTTTAAATAAAAGATTCTCATTATTCA
AAGTAGTTGTACCATTTTACACTTCCACCAGCAAGATGTATCCTGCCTCGGTGTTTGGTTTGTCAGTGGT
TCTAATGTGGCATATCACTGTGGTTTTAATTTGCAGTTCTCTGTTAACTGTGTTCAGCAATTTGTGCTTA
ATGGCCATTTCTGTGTCATATGTCAGGAGGCTGTTCAAGGAGTTCCCTTTGTGGCTCAGGGTAATGAACC
TGACTAGTATCCATGAGGCTGCGGATTCAATCCCGGCCTCACTCAATGTGTTAAGGATCCAGCCCTGCTG
TGGTATAGGCCGGAAGCTGCAGCTCTGATTGGACCCCTAACCTGGGAACTTCCATGTGCCGAAGGTGCTG
CCCTAAAAAGACCAAAAAAAAAAGAGAGAGAGAGAGGCTATTCAAGTCTTCCCCATTTTAAACATTGGT
TTATTTGCTTTTTGTATTATTGAGTTGATGGAATTATTTGTGTATTCTGGATGGAATATTTTTGTTGTC
GGATACATGTGTTTCTCCTAGCCTGTTGCTTGCCTATAAGAGCCCTAAGAGTAGCAGAAGATTCTTTTC
TCTTGTTAGTTTGTTTTGGCCTGTTTAGGAAATCTTAACCCCAAGATCATGAAGATATTCTCTTATATTT
TCTTCTAGAACCTTTGTGGTTTTAGGTTTTACATTTAGATCTATGAGCCATAAGAAATTAACAAATTAGG
GAGTTCCTGTCGTGGCTCAGTGGTTCACGAATCCGACTAGAAACCACGAGGTTTCGCGTCCTATCCCTGC
CCTTGCTCAGTGGGTTAAGGATCTGGCGTTGCTGTGTGAGCTGTGGTGTGGATCACAGACACGGCTCGGA
TCCCAGTTGTTGTGGCTGTGGGGTAGGCCGGCGGCTATAGCTCTGATTAGACCCCTAGCCTGGGATCCTC
CATGTGCCTTGGGTGCAGCCCTAGAAAATACAAAAAAAAAAAAAAAAAAAAGAGCATTCCCCAAGTCAGG
TTAGCATTAACACCATACCTAATAGTGACAGACTGAATGCTTTTTCTCTAAGGTCAGGAACTAGAAAAGG
ATTTGACTCTCACCACTTCAGCATTATAAACTGCAGGTCTTAACCAGGCAAGAAAAAAGAAAGAATTCCT
TGCAGCGTAGCAGGTTAAGGAGCCATTGTTACTGCAGCAGCTCTGGTCACTTCTGTGGCATGAGTTCAAT
CCCTGGCCCAGGAACTTCCATGTGCCTCGGGTGGGGCCAAAAAGAAAAAGACGTAGGAGTTCCTGTTGTG
GCACAGTGGAAACCAATCCGATTAGTAACCACGAGGTTGTGGGTTTGATCCCTGGCCTTGCTCAGTGGGT
TAAGAATACTATGCACTGAGCTGTGGTGTAGGTAACATACTCTGCTCGAATCTGGTATTTCTGTGGCCGT
AGGCCAGCGGCTACAGCTCTGATTCGACCCCTAGCCTGAGAACCTCTGTATGCTGTGGGTGCAGCCCTAA
AAAGCAAAAAAACGAAAGTAAATGTTAACAGTTGCAAAAGAAAACATTGCTTTATTCAGATGCTATAATT
GTGTACACAAAGTGATTATAGCAAGGTTACAAGTTTGAAAAGCAATATGCGGAAATTTTATTTTTGTAGC
AACCTTGAATCTGAAGTCAAAAAATGAATTTTAAAAACAATTCCAGGAGTTCCCTGGTGGCCTGATGGGT
TAAGGACCTGGCATTGTCACTGCTGTGACTGGGGTTGGATCCCTGCAGGGAACTTTTGCAAGCCACGGGC
ACAGCCAAAAAAAAAAAAAATGCTATTTACAATAGCATTGAAAAACATGGTGGAGTTCCCGTCGTGACT
CAGTGGTTAACGAATCCGACCAGGAACCATGAGGTTGCGGGTTCAATCCCTGGCCTGGCTCAGTGGGTTA
AGAATCCGGCATTGCCGTGAGCTGTGGTGTAGGTCGCAGATGTGGCTCAGATCCCACATTGCTGTGGCTC
TGGCATAGGCCGGCGGCTACAGCTCTGATTAGACCCCTAGCCTGGGAACCTCCATATGCCACGGTAGCAG
TCCTAGAAAGGCAAAAAGACAAAAAAATAAAAATAAAAAGTATTTAATTCAGTGTTTTAAAACAACCCT
ACCAGGCTTGGAGGTCCCACTGTGGCATAGTAGTTTAAGAAGCCAGTGTTGCCACAGCTGTGCCATAGGT
CATAGCTGTGGCTCAGATTCGATCCCTGGCCCTAGATCTTCCAATGTCGTGTGTGTGTGGCCAAAAAA
AAATTAAAAAAGATATATAAAATTAAAAATTAAAAAAATTAAAAAAAGATATATATCTCCTCACAGG
CTTGTTTGTGGAAGTTGCCAAGCTGATTCCAAAATGAAACATTAAATAGTGCAGAGTTGGAGGTCTTAAA
ACACCTGTCTTCAAGATTACTATAAAATTAAGTGGCGTTTCTATTGTGGCTCAGCAGTAAAGAACCCAGC
TAGTATCCATGAGGACTCGGCTTCAATCTCTGGCCCTGCCTGATGGCTTAAGGATCTGGTGTTGCCATGA
GCTGCCCTGTAGGTTGCAGACATGGCTCAGATCTGGCGTTTCTCTGTCTGTGGCATAGGCGGGCTGTGAC
TGGACCCCTAGCCTGGGAACTTCCTTCCATATGCAGCAAGTGTGGCTGTGAAAAAGAAAAACAAACAAA
AAACAGTCTGATGGCATTTCAACTGATATACATTTGGCCTCACAAAGCTTTGTGTGGTTGTGGAGAGTGG
CTAGGGGTATAGATGAGACAATAACGCAGAATGTTGATTATTCTTGAAGCTTAGATGTGGGTAAATGGGG

| Sequences |
|---|
| GGACATTATTCTGTTTACTTTTTTATGAGGTTAAAATTTTCCATAATGTTTGTTTATCTTTCTTTTTTAG |
| ATGTTTTTATTTTGGAAAAATGCAGACAGATACAAGAGTAACAACATATTTCCCCACCAAAATTTTTCT |
| TTTTTGTCTTTTTGTCTTTTTGCCATTTCTTGGACCGCTTCCACGGCACATGGAGGTTCCCAGGCTAGGG |
| GTCTAATCAGAGCTGTAGCCGCCAGCCTACACCAGAGCCACAGCAACACGGGATCCAAGCCGCATCTGCA |
| ACCCATACCACAGCTCACAGCAACATCGGATCCCCAACCCACTGAGCAAGGCCAGGGATCGAACCCGAAA |
| CCTCATGGTTCCCAGGCGGATTCGTTAACCACTGAGCCATGATGGGAACTCCACCACCAAATAATTTTAA |
| CACTTAATATTTTGTCCATATTTTAATGTATGGATTTTTTTTTTTTTTTTTTTTTGCCACACCCACA |
| GCATGCAGAAGTTCCCAAGCCAGGAATTGAACTCTCGCCACAGCAGTGACAACGCCAGATCCTTAACCAG |
| TAGGCCACCAGGGAACTTCTGGATGCCGTCTTTTTAAATTTTTCTTTGTTAATAAAGTTAAAACTCCCTT |
| TGACTATACTCCTAGTATCATAAGCACACATCCCTCCTCTCCCTGAGAACGTCACTATCATGGATTTTGT |
| GAATTTTTATTCTTCTTGCCTATCTTTATAATTTCACGTGCATATGTGTATAAGCAATAGTCATTGTATA |
| TTTTTTGATTTCACAATTAAATTAAAATGACTGTGTTTTGCTTTTTTTCTTGCAAATTATCTTTTCACCC |
| CATGTGTTTCTGAGCTGTATCTGGTTCCACATACAGATAATTCATTCCCTAAACCACTGCAGTAAATTT |
| CTCCTGTGAGTGAACACACCGTGTTTCCTTTATCTCCTCCCTACTGATATAAGGTTGTTTCTTGTCACCT |
| GCCATCAGGAACAACGATGACATGAACATTTTGGGGCAAGGCTCCTGCTCCTGCCGCCTGCAACCATTTT |
| TCCAGGGAGTCCATCTAAAAGTGGTTTTGCTAAGTAGTAAGATGTATGTGTTTTCAGTTTTACCAGAGGC |
| TGCCTTGTTTCTTCCCAGAATCAATTGTTTTTTCCCCTATCACATGGCTTTCAGCCAGATGTTTTTTCC |
| ATCAGACTTCTGGGTGAAGCCAGGGGAGCCGTTATTTAGAGCTTGGGTGTGGGAGTTCCCTGGTGGCCCA |
| GCAGTTAAAGGACCTGGCCGTTGTCACTGCTGTGACGCAGCTTCGATCCCCGGCCCGGGAACTTCTGCAT |
| GCCACAGGTGAGGGCAAAAATAAAAATGAAACGTAGGGCTTGGCTGTGCCTCGGATAGCCCAGGTTCAT |
| ATTCCTGCCTCTGCCCCTTGGGAGCTTTCTGGGCCTGAGTAATTCCTTTAACCTCAGTTCCCTCCTCTGA |
| TGATACAGCACCTGCCTCACTGGCTTTTTGAGAGGATTAATGAGATAAGCCAGCGAAAGCTGTGGGTCCA |
| GATAGGGTCTGTTTTCGCAGCAGCCTTGTTGTTCTGATAATGGGCAGGCCTGCCCTGCCTTTGAGTCCAG |
| CCGAGTTTATTGCCTTCCCACCTGGCTGCCGCCCCGATCAGCTTAGCCGGAGAGTCTGGTTCCTCTTCTG |
| ACAGTTTAAGATCATGACCCCCTGATGTTCAGACCCATGGAAAGCACCTACTCTGAAGAGGTTTCCTAGA |
| GAAAAGAACATTGAAAATTTAGTTGCTACCAGCCACTGAGGGAGAGACACCTCCTATGTCCATGGGGCTG |
| TCTCCCCCTCAGTGGGCCTGAGACCCTGACCCACCATCCCCGACAGCCCACATACCCACGGGTTTATTG |
| AACACGGGGTTGCGGGAAAGAAGTGAGCTAGOACAGATGTGGGCAGAACCACAAAAACCCCACCCCCCTG |
| CAATCACAGAGCTCTCGCTCTCAATAATAGAGAACCAGGAGTTCCCACTGTGGTTCAGCAGTAACGAACC |
| CGAATGGGCTCCATGAGGACGCAGGTTCGATCCCTGGCCTCACTCAGTGGGTTAAGGATCCGGTGTCGCC |
| ATGAGCTGAGCTGTGGTGTAGGTTGCAGACATGGCTCGGATCCCGAGTTACTGTGGCTGTATCGTAGGCT |
| GGCGGCTCTAGCTCTCATTCAGCCCCTAGCCTGGGAACTTCCATATGCCACAGGTATGGCCCTAAAAACG |
| TATATATATATCTGGCCCTTTTCTCAACGCTACATTTCCCTTAATAACTGGAGTACTATCTTAGAGCTGA |
| GGACACTTAAGGGACAGAGACGTTAAGCAACCGCCCAAAGTTACACAGCTATTCCATGGTGAGCTTGGGA |
| TGCAGGCCTAGCGCATCTGCCTCTAGAGCCCGTGCTCTGCCATCTTTGCCCTGGGAGCTTTGATGAGTGA |
| AATCATGCAGTGAATTTAAGTGATGATACAACATCAAACCCAGGGCTTCCGACTTCTAAGCCCCATCTCT |
| GTTTACACAAGCCTCCCTTCCATAAAAAACCTCAAAGTTATTTTTATCCTCAATTTAGAGAGGGGGACCCT |
| GGTCCTTCCCCCCAAGGCAAATATTTAGAGTCCCACTGCTGTCCCCTCTTGCCTTCCTTCGTGCACGTTC |
| ATGGCCTGTCCCTGTCATCATTGGGAGCTATATAAGTGGCCCTTTGCCGGCCTCTGACTTTCATCAGCT |
| AAAATCTGCACCTCTAGACGTAACTGATGACAAAAGTTACGTTATGCAAAGTCATCTTAATCTTAATCC |
| TAGGCATTCAAATGGTCAGTTTTTTGTAAAAAGCTCCTTCACTAACCTGTGCATTGCAGGCTGCTCCCTTA |
| ACCTCTCTGAGACTGTCAAGAATCAGGTGTGCTTAGCGAGACAGACAACCCATGTAGAAAGGGTTTGCAC |
| ACTCTAAATAAAGCAGAAAGCAGGCCCTAGGTCAACATAAAGGAGCGAGTGAATATTAGAGGAGATTAGA |
| AAACAGCTGCTTGTTGGAGTTCCTGTCGTGGCACAGCGGAAACAAATCCAATTAAGAACCATGAGGTTGC |
| AGGTTCGATCCCTGGCCTCGCTCCGTGGGTTAAGGATCCGGCATTGCTCTGAGCTGTGGTGACGTCGCA |
| GATGTGGCTCGGATCTGGTGTGGCTGTGGCTGTGGTGTAGGCCGACAGCTGTACCTCCGATTGGACCCCT |
| AGCCTGGGAACCTCCATATGCCGTGGGTGCAGCCATTTTAAAAAAAAAAAAAAAAAAAAAAAGCTGCTT |
| GCTGCGGGTGGGCCGGTGGGGAGGTGTTTTCAGTGCCATTACATTAACACAGAAGGAGAAGAGTAATGGC |
| AGGGATTTTTGCAGCGAGCATAATTCTGAGCAAAGCTGATGACAGATTTGGCTTCGAGAAAGATGGCATG |
| ATGAAACCATTTGAAAGCTGAGCTGGGAGATGAGATGATAGAGGCATAGCCTAGTGCGGGGCCCTGGCCC |
| AGACCACACAGCTACCCCTCGGTCCTCCCTCGTACCCTTGACCAATGATAACCAGCTCACAGCCTGGGCA |
| CAACAATTCATTCAGTCACCACGGTGACTGAGCCCCGAGCAGGTGCAGGGCAGTATGCTAATAGCTGGCG |
| AAGGAGATGCTTCCCTGCCCTGAGGAAGTTTATATCCCAGCAGCACACACAGAGCGAGCGAGAAAGGTCA |
| GCAGGTAGTGTAAGCACGAGGAGCACTAACAACAGGGTGACCTGAATTCGAATAAGGTGACAGAGTTTGG |
| CTGGCTGTCCTTGATCGATCGAGCGGTCTGGGTCCCTGCTGAGGTGTGACCCTCAGGATGGGTCCCAGT |
| GAGAAGGAGCTTGCCCTTCAGTGATGGCAGGACCACTGTTCCCAGGAGTGAAATGAACCAGCGAAGGTCC |
| GCCGTGCAGGAAAGGGCAGCCACTGCCGCTCGAGCATCGGGAAGGGAGGGGGTGCTAGAAGATGAGATCA |
| GAGAGGTGGGCAGGGGCTGGGTGGTGAGGAATTTGTATGCCAAGGTGGGGGGGCCGGCCCCAAGGGAGC |
| AGGGGGGAACGTGGGGGGGCCAGGGAGGCATCTCCCCCTGCCCCGCCCTGACCGCGGTGGAGGGACAGGG |
| CTGAGTTACTTCATCCTGATTCCCACAGAGGAGGGCAGACATGGGTACACGTGGCGGAAGGCTTGTGGAT |
| TCAGTGGTGGAAGGGTGGACAATCCCTCTCTGGTTATCTTTTCCCCGCGGGGATGTGCGTGGTGAGGGGT |
| GGGGCAGGTGCAGCCTGGCATGTGAAGGGCAGGGCGCTGCCCCAGCAGCAGAGCCTCACCACGGGTGAGT |
| GTGGACGGAGGGGGTCCCTCTTCCCTCGGGGCTTGGGTGTGTCTCAGGCTGGATCCTGGCCTTTCTCCCC |
| ACAGCGGCCACACTCCCTCCAGGGAGCTGCAATGGAGGAGTCGCAGTCCGAGCTGGCGTGGAGCCCCC |
| TCTGAGTCAGGAGACATTTTCAGACTTGTGGAAACTGTGAGTGGAGTCTCAAGGGAGGGCTGCCCGTCTT |
| CTAATAACCTTGCTTCCCCCCCACCAGCCCCCAGCCCCCAGTAGAGGCCTCTGGGAAGCACAG |
| ACCTATACTGACTCTCTGCCCTTGTCTTCCAGGCTTCCTGAAAACAACCTGCTGGTAAGGACTGGGGCGC |
| GGCAAGGGCAGGGCCTGGGGGCTGGGGGCTGGCCTCCTGACTCCTGTTGTTCCCATCCATCCGCAGT |
| CCTCTGAGCTCTCCCTGGCAGCAGTGAACGATCTGCTGCTGTCCCAGTCACGAACTGGCTGGATGAAAA |
| TCCAGATGACGCCTCCAGAGTGCCAGCGCCTCCTGCAGCAACAGCGCCCGCACCAGCTGCCCCCGCACCA |
| GCCACCTCCTGGCCCCTGTCGTCTTTGTCCCTTCTCAGAAGACCTACCCTGGCAGCTATGATTTCCGTC |
| TAGGGTTCCTGCATTCTGGAACAGCCAAGTCTGTAACCTGCACGGTCAGTGCCTTGAGGGACTGGCTTC |
| GTAGGGACAGTGCCTGGCCCCTATCCCCCCGGGTTTTTCTGTTTAGAACTTCGTGGTTCCACTGCAGCCT |
| TTGGCTTTGTGTCAGGCTTTCTATGTTTAACCTATTTGGTCTATGACCTTGGACCCTGGTCCCAAAGTTG |
| AATACTCCCACTTGACCTTGGCCTCTCATCCTTCCCATCACACTCTTCAGCATTTGTCATGAGGCCATGG |
| AACTTTTTTCTTTTCTCTCCACTCATTCATTCCTTGGCTTTTGTAAGGAAGCTTCTGGGAGGGAGCCCC |
| CGACCCTGCCATCTCTGGCTACCCTCCCCACCGAGCACTTGGCTGCTAATCAGTATTTAGGCAGCGTCTG |

-continued

| Sequences |
|---|
| TTCATTTGACTGCTGGCTCCCTGTCCTCTGACCTTCTGTTCGCTCTCCATCCTCCCTTTCCTGCAGTACT |
| CCCCTGCCCTCAATAAGCTGTTTTGCCAGCTGGCCAAGACCTGCCCGGTGCAGCTGTGGGTCAGCTCGCC |
| ACCCCCGCCTGGCACCCGTGTCCGCGCCATGGCCATCTACAAGAAGTCAGAGTACATGACCGAGGTGGTG |
| AGGCGCTGTCCCCACCCATGAGCGCAGCTCTGACTATAGCGATGGTGAGTGGGCGGGGGCTGTGGGTGGGA |
| CAGGGCTGGTGCCGGAGCTGCCAAACCCCTCATTCCCACCCCCACCCCCCGATTGCTCTCAGGTCTGGCC |
| CCTCCCCAGCATCTCATCCGGGTGGAAGGGGAATTTACGGGCCGAGTACTTGGATGACAGAAACACTTTTC |
| GACACAGCGTGGTGGTGCCCTACGAGCCGCCCGAGGTCTGGTTTGGCCCCTGGGGTCTCCGGGAGGAGGG |
| GGCCAGAGGGGTTTGTCCGTGGCCTTCCTGGTGGGAGATGGGGCGGCTTTCTCCTTCTCACTTGACCTGC |
| CGCAGCCTCGTGAGGCGGGTAGAACAGATGGGTTACCCCCATTCCACAGCTGAGGCGCCCAGAGGCCAGT |
| GGCCTGCCGGGGCTAGTAGGGTCACCTTGGGCCTGTGTCGTCCCCAGGTCGGCTCTGACTGTACCACCA |
| TCCACTACAACTTCATGTGCAACAGCTCCTGCATGGGGGGCATGAACGGGCGGCCCATCCTCACCATCAT |
| CACACTGGAAGACGCCAGGTAGGGGCCACACGCCGCCCTCCACGCTGGCGGGCCCCTCCTCAGCCTCTGC |
| CTGTCTCCATGGCCCTGCCGCTCATCCCCTTCTCCCGGGCTTCCAGCCATCCTTCCCTCTGGCTGCAGCC |
| ACTTTGCGTCCCTCTGCTGCTCCCTCCCAGTGCCCTTTTCCCCGGCTTTGGCACCCCTCTTACCTGTGGC |
| TTCTTGATCAGCTGGAGCTGAGGCTCCTCGTAGGATGCGGGGGATGGGGAGGGGGTGGGGCCCCGCTCAC |
| AGAGCAGGGAGGCCGGGCTGGCTTTCCTCACTGCCTCCTACTTCCCCCCGGGGTAGTGGCAACTTGCTGG |
| GACGGAACAGCTTTGAGGTGCGTGTTTGTGCCTGTCCTGGGAGAGACCGCCGCACAGAGGAAGAAAATTT |
| CCTCAAGAAGGGCCAGTCTTGCCCCGAGCCGCCCCCTGGCAGCACTAAGCGAGGTAAGCAGGCAGGACCA |
| GGAGGGGTAGAGGGGACAGGGAGGGGGCGGTTCTGCCCAAAATGCACTCTTTTCTCACCTTTCCTCACCT |
| CTTTCCCAGCACTGCCCACCAGCACCAGCTCCTCGCCAGTGCAAAAGAAGAAGCCACTGGATGGCGAGTA |
| TTTCACCCTCCAGGTATCGAGTCTGGGAGAGAGAGGGGCCGTTTCCTGCTCTTACTCAGTGGGGTTGGAT |
| AAGGGGAGAAAAGCTACAAAGGTAGCAGGTGTGAGGTTATGCCCAGTTTCTCTAGCCATCCTTTCGTCTG |
| TTCATCGGCTTGACTCTTGTAGTGCATATTATCTATCGGGTTTGAGAGATTGAAGTTTCACTTGGGTCAC |
| TCCATATGTTAATTTCTTCTTGACTGCTTTGCCTGCATTTGGGGCATTTGCCAACAGGGGGCAGTAGTGC |
| CTTGAAACAGTGGCTTTATTTATTTATTTATCTTTTAGGGCTGCACCCTCTGCATATGGAGGTTCCCAG |
| GCTAGGGGTCAAATCGGAGCTGTAGTTGCCGGCCTCTGCCACAGCCACAGCAATGCAGGATCGGAGTCTC |
| TTCTGCAACCTACACCAGAGTTCACGGCAACACAGGATCCTTAACCCACTGAGCAAGGTCAGGGATCGAA |
| CCCGTGTGCTCATGGATGCTAGTCCGGTTCATTACTGCTGAGCCACGGCTAGAACTCCCTAACATAACAT |
| TTTAAAGAACCCTCTTCCAAAAAGAAAGTTGTTAAAGAGAGCATAAAAATAGTTCTTGTGAGAATTTCCT |
| TGTGCAGCGAGTTAAGAACTGGACTAGTATCCATGAGGAGTCCAGTTCGATCCCTGGCCTCCCTCAGTGG |
| TAAGGATCCCAAAGGTGTGGCGTGGCTGTGGCTGTGGCTGTGGTGTAGACCAGCGGCTACAGCTCAGATT |
| GGACCCCTAGCCTGGGAGCTTCCATATGCCATGAATGTGGCCCTAAAAAGAAAAAAAAGTAGTTCTTATG |
| ACTTTGCCTAATGCTCCTCCACCCCTTCCCTGCCACAGATCCGTGGGCGTGAACGCTTCGAGATGTTCCG |
| AGAGCTGAATGACGCCTTGGAGCTGAAGGATGCCCAGACTGCGAGGGAGTCGGGGGAAAACAGGGCCCAC |
| TCCAGGTGAGTGACCCGCGTCCCTCCCTTGCATTCCTGCGTTGGAAAGCCGCGGGGTCCACTCTAACCC |
| TACAGGTGGTAAAGGGCAGCTGAGCCCCTGCTGTTGGGTCCAACATTCCTCCACTTTCTTGCCTCCAGGG |
| GTCCACACGCCTCTTGAGCCCAGGGGCATGGGATGTTTTCTTTCCCACTTCTAGCAACCCTTAGACCCTC |
| AGAGCTGGGGTCTTAGATGGGGGCCTGATAGCCATGGGAGGGTCAGACTCAGCACTGGGGGTCAGATCC |
| TCAGCCCTACAAAGTACTAAGGAGTCCTGTGTGGCCTTGTTATTCGCCTTCTCAGGCTCAGTTTCCTCAT |
| TGTCACATGGGATAAGGGGGCAATTTCAAGGTTAATACCTCTAGGTGCTCAGTTAGTAGGTCTGCAGTTG |
| GCAGTGACTTTTTTTTTTTTTGTCTTTTAGGGCCACAACCACGGCACATGGAAGTTCCAGGCTAGGG |
| GTGGAATCAGAGTTGCAGCCACTGGCCTATGCCTCAACCACAGCAATGCAGGATCCGAGCTGCATCTGCA |
| ACCTCCACCACAGTTCACGGCAATGCCAGATCCTTAACCCACTTAGCGAGCCCAGGGATGAAACCCGTGT |
| CCTCATGGCTACTAGCTGAGCCACAGCGGGAACTCTAAGCATTTTAACTTAAATTCTCCTCCCTCCCGCC |
| TCAGGCCTTGCAAAGCCCAGCTCCAGGAAGAGGGGCTCAGAGCCTCCCATTGGGATAACATCATCCCCTC |
| CTCTCCCCCTCTCTCCTCACAGCCACCTGAAGTCTAAGAAGGGGCAGTCTCCCTCCCGCCATAAAAAACC |
| GATGTTCAAGAGAGAAGGACCTGACTCAGACTGATGCCTCCTGCATCCCATCCCCTTTTGAAGTCCCTGG |
| CATTTTGGGGACTCAGGTGCTTAGACCTCTGCTTGGTGCAGGTGTGCCTTAGAAATGCCCTGGAATTCCT |
| CTATATGCTTGGCCTGGGCTCTGCTAAAGAAATTGGCCTGCACTGGTGGGTTGCGGGGTGGGGGTGGGG |
| GGGTGGATAAGGGGTACTGGGGGCCTTCCGGCTTAGCTTTTTAAGGGTTTTTGTATTTTTTTATTAAAT |
| TTTTTTCATTTTTTAAAGTTTAAAGTATAGTTGCTGTTTCCGTGTGTTTTTAAAGGGTTTTATTGGTAA |
| AATGTTCAGAGAGGTAGGAAAATGTTCCTGCGTATCAGGAACAGGTTACCACCAGCCATACACTGGGTCG |
| GAAGCCCAGTTCTCCACCGTAATAGGCAGAAGAGTGCCTTTCCCTGATAACCTCCCTCCCCATGCTGTT |
| GGGAGAATTTATGAAATAATGTATTGTTTTCTTTTTATATGTTTCTTATTTTCCAATAAAATAGTGTGGT |
| AGCA (SEQ ID NO: 39) |

Human BCL2 (Gene ID: 596)
Location: chromosome 18 Exon count: 6
Range: 5001..201035 (196035 bp)
>NC_000018.10:c63320280-53123346 Homo sapiens chromosome 18, GRCh38.p12
Primary Assembly
GAGGGGGCGGTCGGGTGGCTCAGAGGAGGGCTCTTTCTTCTTCTTTTTTTGAATGAACCGTGTGACGTT
ACGCACAGGAAACCGGTCGGGCTGTGCAGAGAATGAAGTAAGAGGACAGGCACCACAGCCCCGCTCCCGC
CCCCTTCCTCCCGCGCCCGCCCCTCCGCGCCGCCTGCCCGCCCGCCCGCCGCGCTCCCGCCCGCCGCTCT
CCGTGGCCCCGCCGCGCTGCCGCCGCCGCCGCTGCCAGCGAAGGTGCGGGGCTCCGGGCCTCCCTGCC
GGCGGCCGTCAGCGCTCGGAGCGGGCTGCGCGGCCGGAGCTCCGGAGGGCGCGTAGCCAGCGCCGCCG
CGCAGGACCAGGAGGAGGAGAAAGGGTGCGCAGCCCGGAGGCGGGGTGCGCCGGTGGGGTGCAGCGGAAG
AGGGGGTCCAGGGGGAGAACTTCGTAGCAGTCATCCTTTTTAGGAAAAGAGGGAAAAPATAAAACCCTC
CCCCACCCACCTCCTTCTCCCCACCCCTCGCCGCACCACACAGCGCGGGCTTCTAGCGCTCGGCACCGG
CGGGCCAGGCGCGTCCTGCCTTCATTTATCCAGCAGCTTTTCGGAAAATGCATTTGCTGTTCGGAGTTTA
ATCAGAAGAGGATTCCTGCCTCCGTCCCCGGCTCCTTCATCGTCCCCTCCCCTGTCTCTCCTGGGG
AGGCGTGAAGCGGTCCCGTGGATAGAGATTCATGCCTGTGCCCGCGCGTGTGTGCGCGCGTGTAAATTGC
CGAGAAGGGGAAAACATCACAGGACTTCTGCAATACCGGACTGAAAATTGTAATTCATCTGCCGCCGCC
GCTGCCTTTTTTTTTTCTCGAGCTCTTGAGATCTCCGGTTGGGATTCCTGCGGATTGACATTTCTGTGAA
GCAGAAGTCTGGGAATCGATCTGGAAATCCTCCTAATTTTTACTCCCTCTCCCCGCGACTCCTGATTCAT
TGGGAAGTTTCAAATCAGCTATAACTGGAGAGTGCTGAAGATTGATGGGATCGTTGCCTTATGCATTTGT
TTTGGTTTTACAAAAAGGAAACTTGACAGAGGATCATGCTGTACTTAAAAAATACAAGTAAGTTCTCTGC -continued Sequences

```
ACAGGAAATTGGTTTAATGTAACTTTCAATGGAAACCTTTGAGATTTTTTACTTAAAGTGCATTCGAGTA
AATTTAATTTCCAGGCAGCTTAATACATTCTTTTTAGCCGTGTTACTTGTAGTGTGTATGCCCTGCTTTC
ACTCAGTGTGTACAGGGAAACGCACCTGATTTTTTACTTATTAGTTTGTTTTTTCTTTAACCTTTCAGCA
TCACAGAGGAAGTAGACTGATATTAACAATACTTACTAATAATAACGTGCCTCATGAAATAAAGATCCGA
AAGGAATTGGAATAAAAATTTCCTGCATCTCATGCCAAGGGGGAAACACCAGAATCAAGTGTTCCGCGTG
ATTGAAGACACCCCCTCGTCCAAGAATGCAAAGCACATCCAATAAAATAGCTGGATTATAACTCCTCTTC
TTTCTCTGGGGGCCGTGGGGTGGGAGCTGGGGCGAGAGGTGCCGTTGGCCCCCGTTGCTTTTCCTCTGGG
AAGGATGGCGCACGCTGGGAGAACAGGGTACGATAACCGGGAGATAGTGATGAAGTACATCCATTATAAG
CTGTCGCAGAGGGGCTACGAGTGGGATGCGGGAGATGTGGGCGCCGCGCCCCGGGGGCCGCCCCCGCAC
CGGGCATCTTCTCCTCCCAGCCCGGGCACACGCCCCATCCAGCCGCATCCCGGGACCCGGTCGCCAGGAC
CTCGCCGCTGCAGACCCCGGCTGCCCCCGGCGCCGCCGCGGGGCCTGCGCTCAGCCCGGTGCCACCTGTG
GTCCACCTGACCCTCCGCCAGGCCGGCGACGACTTCTCCCGCCGCTACCGCCGCGACTTCGCCGAGATGT
CCAGCCAGCTGCACCTGACGCCCTTCACCGCGCGGGGACGCTTTGCCACGGTGGTGGAGGAGCTCTTCAG
GGACGGGGTGAACTGGGGGAGGATTGTGGCCTTCTTTGAGTTCGGTGGGGTCATGTGTGTGGAGAGCGTC
AACCGGGAGATGTCGCCCCTGGTGGACAACATCGCCCTGTGGATGACTGAGTACCTGAACCGGCACCTGC
ACACCTGGATCCAGGATAACGGAGGCTGGGTAGGTGCACTTGGTGATGTGAGTCTGGGCTGAGGCCACAG
GTCCGAGATGCGGGGGTTGGAGTGCGGGTGGGCTCCTGGGGCAATGGGAGGCTGTGGAGCCGGCGAAATA
AAATCAGAGTTGTTGCTTCCCGGCGTCCCTACCTCCTCCTCTGGACAAAGCGTTCACTCCCAACCTGACC
GATAACGCCTGCCATCTAAAAGTCTTTAACTTGCTTGCTAGTCGTGGAGATCCAAAGATCTAGCGTTTGT
AATCCAGTAGGATGTGGTGGTAAATGGTACCCCTTCAGTGTTTCTCAAGCTGAAGGTCCAGGAGTCCCCA
GGACCACCGTTTCCTGGCTTGAGCAGCTTGTTGGAACCGGAGGGAGGTTTCAGGGACTGCTTATGAACCA
GATACCAGGTTGGGTCTTGACAGTCTGCATCCCAAACAAGCTCCCCTGAAACAAGCCCGTTGTACACTAA
AATTGGAGAACAACCCGATTAGAAGAATAGACTCCACAGAAGACCAAGGGCATCATCAATCGGTAAAATT
TTCCAAAGAGGAAAACCAATGTAAGTCTTTTTCCCTGAAAAACTTAGTTGTGTTTGTAAAGAGCTAAGT
TGACATTCCAAAGTCCTTGGACTGGAATCTCCAGTGTGTGCCATGTTCCCAGTGGGCGTGATGAGGTGTC
CTGAGGAGTATCAGGCTATGGCTTTGCTACCTTGTCAGTGACAGAATTTGCATCGGCTGCATTCTTTGTA
TTCTATAATTTGTGTATGGTTTACCAGTTTGCTAGAATGTTAGAATCTTTTGTTTTTCACCACTCAGAGT
GGACCTAATTTTGTGGTCGGCTGAAAAAAATTTGCATCTAGGTATCTATGTAAAGTGTAGAAGAATTGAT
TCTTAGCTGTGGATTATCTTACCCTTACTTTAGTTGAAGTGATTGATACCTGTGGCTTTGAAGAACATTT
GTGAGATGATCTTTTTCTCGTACTGTGCTAGATAGAGCTTTCATGATTATACCATACAATTGTACTTTTC
TGAGATTCTTTGTTGGAGGGGGTTTAGTTCCTAAGAGTCAAGGATTGTAATGGAGATCTATATCTCATAT
CTAAAATGATGAATTTATGAAAAAGTAATTCTTGTGTGAAGTTTTTTTTTTTTTTACACTTTTTGTTTTA
ATCTGAAGAGTTATCTTTGAAAAACAGGATGCAATTCAGTGCTTCCTTTTATAGCCTCTTGGGAGAATGA
CTAATGTCATTATTTTATAGGACCTAACAGGAGCAAAAGCCTAGAAATTACTGCAAGTGGATTAGATGT
CAAGAAGCACACCACATGTTTTTATTACATTTTACAAAGTGTGCTCATACTAGGAGGCCAAATAGAGAAA
AGGCCAAGAAAAGTAGATGATTGATGTGAACATCTGATCTTATTTGACCAAAGTTGACAAAATATTGATG
CCACTGTTTGGTGTTTAAAAGTAAGATTAACTAAAATGCCCCAATTTAAATTTCTAAAATTTAAATCCTC
TTCTTGAATTGTTTGTTTGTTGAGATCTCACATTATCAGATCTTTAGTAATTCTGGAAGAATTTGCTAAA
GGGTGAAAAGAATATTTTTGTTAAATATTTGGTTAAGTAGGTGGTTTGATTTTTAATCACTATAACTAAA
GGGGTTGGGACTTCCAGATTCCCAAAGGATCCTTTTAAACCAAAGTAAAACTGATTTAATAGTTTTACTA
TTTCACATTTTTGTGAAAAATTCACACTTACAAATTTTCTTTCTACTTGAAATAAATCCAAGGTGGTAAC
TGGTATCTGTCTATCAAATAAGTTAATAAAAATGTGGGAAACAGAGACACATGTTTATGACAGAAATTAA
GATACAACCTTGATATTTGTTGCTGAATTTCAGTGTGTTACCCTCTCATGTAACTGAAGTTTCTTTTTAA
GTAAAGGCTCACTTTTTTCTTTTTGTGAAACAGAGTTTTCATAGTAGACCTATCTTTGTGGTCAACAGGT
ATCTGAGGTTGATAAATGTAGAGGCTACATTTTATGATGCCAAACCACAATGACATACCATAGAACATGA
TAAAAATTTTTTGACAAAACTGCTTCTAGTAAAAATAAATCATGTAGAAGCACAGATGGTTGATGGTAAA
ATATGTAATAGCTTTCAGAACAATGCATAGATGGTGACTATATAGGAAAACAAAGGAATTTAGAGAAAA
ATATATATATATACCAGGAAATGCACTCATAGGACACTTTGGAATAAAAGTGGTAGTGTTTGAGAATGAT
GAATGATTTGCCTATCATTTCAAATGTGCATTATTAATCTAAAAGTCATTTTAGGCATTTTGGCATACAGA
CAGATTTTCTTCACATTTACACCAATTGGGGTTACATCTCTAATAATATGTTGTATTTTATAGTGTAAGG
TAGTCTTAATGGTAAAGCTTCAGAAGAGAGCTAGCATATTTTCTTGGCATGTGACAATAATCTGCACTGT
CCCCAGGGCTCCGTGGATTAGCCCATCTCCTGAATACTACACTGAATACTCCAGGCTTTAGACTGCAAGT
CATTTCTTTTTCTTTGCTGCTGCTCGTAGAAAATTGGAACCTTGTGAGGCTGAGGAAATCTGTTTTGACTT
TTGTGTTCCATAACATGGATAAATCAGGTCCTTGGAATGATCAGCCTCTGATAGATTGTCCCAGAAGACT
ACAAATTAAATAAAGACTAAAGAAGTAATTGGCTGTAGAGTGGAGTGTGGATTTATTCCTAGGTCTGAAT
AAGGCATTGTGTGGCATCCAGAGAGAGGCAGGACAGAGGAAGCAGTGAGAGAGAAGCAATTCTAGAAAAT
GTGGATACCTTGCTGCTCAGTGTGGCTTATAGACAGTAGCACATGCATCCCCCGGAGCTTTGTAGAGATG
CTAAAGCTCAGCTCCCACCCCAGAGCTACTGAGTCAGAATATGTGGTTTGTGTGCACGTTAAAGTTAGCG
ATGCTGGCTACCATCCTTGGTTCCTGGTGGCATCTTTTAGGAAGAGTTGCTACCTGGGATGGATTCTGCA
TTGTCCCCTTCCAGTGGCCTTAAAGATCTATAGTGTTACTTGGAATACCGAGTATTTCCCAGGTGTCCAC
TATTGTGATCTGACTTTAGGAAGACATAAATTGGATGAAGGAGAGATGCAAGCAGGTAGATCAACTATA
AGCCCAGTCTTCTCATGAATATTTTTCGTAGTAGTTATATAGTTTATATTGGCATCACTGGTCCCATTAA
AAAGTAAGATAGCTTTCTTCAATTAAAGGCAAGAGAATTAGCTCTTTTAATAGCTCTGTTAGTTATTAT
TTTATCCCCTCATAACACAGTTTAAATTCTGTAAATGACTTTAGTGACCTTGCAGCTTCTTTAAGACAAA
GGGACTCTTGCAGGCAAGGGATTGAGTTTTGGGCAGGTGATGGAGAGTGACCCTCTAAACTGGGAACTGT
GAGGACATTCAGCTTCATGTCTTAGGAGAGAGTGAGATAGGAGCCACTAGAAGAATGAGATGATTCAGAC
AAGAGATTGTAGGAGATTGGCTTTATTCTGTTGACAAGATGGTAATCCGACTTATTTTTGGTTTTTTGG
TGTTGGTGGTTTAGGAAGACAGGAACTTCTCCACACCCGGTAGAGTTCAGCTGCCTTTTCATTAGTCAGC
AAGCAGTTTTTCCTTTCTCAAGGCAGTCCACATCCAGCAAAACATTTGATTAACTGGAAAGCAATACCAT
TCTCATGCCAGTGTACAAATTACATGAAAGAGCATCATTTTTCTAGTGTCTGAGGATTGGCTGCTTATGG
CCAATTTTGGCAGCAAGACGATAGGATTAAAAATAGCTTGAAGATGCTAGTCTTAAATAATATATTTC
ATGATGAACTTTCCTTGGGAAAGTGCATCTTTCTGCCTACAAGAATCACATGACCCCTTTCAATAATTTA
TGTAGTAGAGAAAAACACACTATTTCTCATAGAGTTTTCAGTCATGTGCTGTGGTGATTGTTTCTGGA
CATTCATAAAATTTATAGTTAACTGAATTCTCTTTTCTGTTTTGTTGCTATTTAACGTCCATTGAAAAC
ATGGCTTTCTTTTGCGCATTCTGTTACTTTCAGCTGTACTTTCTAATAAGAATGGATTGCCCTTTTTAGC
AATCTTTGATTGAACTGGTACATTTCAGATTACTTAAATGTCATCAGGCCACACAGCATACCAGGTAACA
GAAAGCCATAAATTAAAAATAAAAAAAAGGCAAGCAAAATTCTTGTTGTTTTTTCTTATCTCTGTTCCCA
```

-continued

Sequences

```
GTCCTATTGCGCTATTTGGAGGGATGATACGCCCACTCATGAGCGAGTGTGTGGGTGCTGCATGTTAACA
GTGGTTCTTCCCACCCAACATACCTCCGCACCCTTTTCTAAGGTCACTCATTGTGTCTTAGCAGTAGTTT
AGCAAAGCAGTATCTCAGCAGAAGTGCATTTGTGCTAGAAAACAACACTGTCTTTGTAGTGTACAAGTAG
AACGTTTTCTTTTTCCCCCAGAGATATATTGTATTTGAGATTCAAAGGTTCTGTTCAACCTTTTTAAGGT
AATCTAATATCACCTTATTCAGGTATAACAGTAACTTGTCAATCTGGTCATCCTTTCTGTCAACCACATG
TAGGAGACCACTCAGTGAATTTACTCCACTGTGAATTTTCTCTTTCATCCCTCTTGGTTTGGCTTAATCA
ACCTTAATGTTTGATGTCTAAGCAGGATTAATGATGAAAATCATCCAAGGACTGACAGTTATTCCACAGA
TGTGATTGCCAGTCTTACATGAGTCCTGCCTTGGGTTAGGTTGGAGGCACGGCAAGGAGAGCTTTGCTTC
TGCCCTGGATAAACTCACAGGCTAGTGTTGCAGGCATCTTAATAAACTCGTAGTTATCATACAGCCTGAT
AAGCATGATCCTAGACTCAGAGACTTAGAGGAAAAAAGCAAATAACTATAAGTTATTTTGCATGTACTTC
AGCCTTGGTCTAAGAACGTTATTTCTGACCATATGGCTGTTCATGTGTGCATTAGGCCTAATTTAAACAG
GGCCAAAATGTAGATACTTTAAAAAATACTGTGTAACGTAGACATATGCTTAAGAGAACTGAAAGGCAGG
GGGAGTTCCCTTGTTAAATATTAACCCACTAAGCACTATTTATGCATACTAAGAAGACTTAATAAACACC
AGTCTACAATTTCTAAAGCATTTCATTAATTCTTTTTAAGTAAAAGACAATCAAGGCTCCGATTAGACTG
ACTGGAACAGGGTAATTTGAAGAACTATCTTTCTTAAATAACTCTTGTATGCCAAAAAATACAAGTAGGT
TTTGAACCAGAGCGGGGGCTCTTCCTTTGAGCAGGGGAAAAAAAAGCTTCTGTTTTGTTTTGGTTTGAGG
TTATATTACTGTTCTATTTATCAAGACACTTCTACGATGCTAGTTACAGAAATTCACAGTCCATTGTAAC
ACTGGCATTTGCCTTCGGACTTTTTTGGGCTTGTGGTCTGTTCGTTTAAATGGAGACTGTAAAACTTTCA
AAATGCCAACAAAGCTGTTTTCACTTAAAAACATATTTTTATAGATTGTCACTTGTTGTTCTTATATATG
CCCAATTCTGTATATGCTATAGCACTATTTCTCTGCCCTCCCATTGCCAGACAAAAGATACACCCATCTG
TCCTTCAGTGTGAATAAGGATTGAATGATTATTCCTCTCTCTTCCAAGCCATGGGACTTTCTCATAGGTG
CCACCACCCCTGTGACCATCCCCTACCTGCCTTATCATTCCACCGGTGAGGGACCTCTCAGGTGTAGCTC
CTTGTTAACTTCCAATTAGTGATGGGTAGGATTTACCTGAAGAAAACCGTAATGCGCTTAGATACTAGCA
AAAGGGAGCAGAAGTGGGGAGTCTAATCAAAGTGAGAGGATAACCCTCACCCCAAACTTGCTGCAGGCAG
CTGGGCAGGTCAAAATTCTGTGACCAGACACTATCCTTTTCCTCTAGTGATTATAAACTTTAACCTGTGC
AGAGAAAAGATAGTATCTGCTGGCAAAATTTGTACTTACTTTGATTCCTCTAGTGCAAGATTATAGTGGG
GTTATACCTGAGACTTCAATAAATGTTTGACTAACTAAACTAAAATAGCTTAGGGTAAGGACTACTTCCC
CAAACGCCCTTTTAAACATGTGAGAAAGGGAATCTCCCTGACATACTGGTATGGCCATTTGTAGCAATAT
ACTGAGAGTGACTTGGGTGATTTTCTGGGGCGATCAACCACATTCCATGAGCAGGTTAACTGTGGAAGAC
ACCTGCCCTTGAGCATCGCGTTTGGGCCACATGCGTCAATGGGGAAATTTGTGTTTCCATTCTGCTTCTT
GTTTTGCCTTCACAACTTCAGGGATAGAAGCGTATTCCATTTTTAGTTAATAATCAGCTCTCTGGGGCTT
CCATGTAATGAGTCAGAAACTGATGACTGACTCCACTCTGCTCATTATCATGTCTCCCAAAAACAACCCG
AGAACCCACTGTGTCAAGTGAAGCTTTAATTTTTCAGGGGAGGTTTTCTCCATTGAGACCAATACATCTT
TTCTTGTGACAGATCCAGTTACCATATTTCCTTATTTTTAACTGTCGAAAAGACAGTTAAGCTGCAACAG
AGTATGGTGAGTTTACCAATTTTAATACTTGAAGCACCAAACAAAGGATCAGTGTTGCAGGCGTGTCTCTT
CTTGACTTTTTCCAGCTCTCCTTAGCAGATAACCAGGATGATATTTTTCTGCTTTACAACATGATGAAT
GCTATATCTCTATATTAACTCTGAAATTGAATTGCAGCCAAATATTCCTCTCAGCTGCATTAGAATTTTC
TAAAAGAACATGAGACACATAAACTTAGTCTTCTTAGTTCAATGCTATATCTCAGATATATTGATATCTG
ATTTAGAATTAAAATAGGAATAAAATTAAGTACAAATTATATCATCAGCTTTAAATATTGATTTATCTTC
TTGAAAAAAAAAAAGCGAGTCCATAAAGGATGGCAGCATTTCTGGATGTAAAATTTCAGGGCTA
TCTCCTAGCCATATCCTTTATGGATTCCTGCCAGCATCTTTAAAAACACACACACTGAAGACACACAGAG
AGGTTTTGAGGTATTTTATAAGAAAATTATAAGAACAGGGAGACAAAGCCACTTACTAAACATTAAAGTG
ATAGTATAAGAAGAAAATGATTTGAAGAAGTCCTAATTGAGGGAAATGAGCAATTGTCCACAAAACTTAA
CCCTGGGTTCCCAGGAACCGGGGTAGTGATGGTCATGGAGAGGGGTTTTAGAATCTGGTTATTTAGGAAA
ACATGCACACTAACTTGTTTCATTGAAAAAAAACATTTATTGAGGCCCTCAACCATGCAAAGCTCTATGCT
AGGTGTTTTAGTTAAGCGAAAAAATGTCTAAGATAACTTTTGCCTTCAAGGAACTTACCAATCAGTAGGA
GACCAAGACAAGGATACAAATCACTGTAATCCTGGACAATGTGTAGTAGACAGAGAGGCCCAACCCAGCT
ACAGTGGTATCTGAAGAGTTTCATGCCGGAGATAATGTTGAGAGAAGTTTTAGAGAACAGGCAGGCGATA
CGGGGAGAGGGTCTTTCAGGTAGTGGAAACTGGAGGCGTCAAAGCAGGCATGAATGCGGAGGTGTGTTT
GGGGAATTGTGGAGAGTCTGATTTGACTGGGGCATGGAGAACTCTCCTGAGATAAATCCATAGTTTTGAG
AACTTACCACTGCATACTAAGTTGTGAAACTTGTATAGACAGCCCTCCCTATCTTTGGGTTCCACATCCA
TGGATTCAACCAACTTTGGATCAAAAATATATGGGGTAGGGCAGGCACAGTGGCTTAGGCCTGTAATCCC
AGCACTGTGGGAGCTCAAGGTGGGTGGATCACTTGAAGTCAGGAGTTCAAGTCCAGCCTGGCCAACATGG
TGAAACCCTTTCTCTACTAAAAATAGAAAAATTAGCCAGGTGTGGTGGTGGGCGCCTGTAATCCCAGCTA
CTCGGGAGGCTGAGGCAGGAGAATTGCTTGAACCCAGGAGGCGGAGGTTGCAGTGAGCCGAGATCGTGTC
ACTGCACTCCAGCCTAGGGGACAGAGCGAGACTCTGTCTCAAAAAATAAATAAATAAACAAACAAATAAA
TAAAATAAAGTATATAGGAGGATGTGCATATGCAAGTACTACTCATTTAATATCAGGGACTTGAGCATCT
TCAGATTTTGGTATCCACTGGGGGTTCCTAGAGCCAATCCCCTGAGGTTACTGAAGGATGGCTGCGTTTA
ACTGTACCAGGGATGTTGAAAGGATGTTGCAAAGGTTCTCAGACAAGGCAGGATGTGTGCGTGGGAGGAA
GATTGACAGTGACTGAGCCTGGACGGGGGAGACCAGGTATGAGGTCTGAAGCACCTGGAACAGAAAGGAC
AGGACAGATGTGGGCACACTGCACGTGTAGAATCAAAGGACTGACAGCAGGTCGAATGTGAGGAATGAAG
GAGGGAAAGAATCAGGACTCAAGTGCCATCCTGGCTGCCTCAAAAAATGATACTGTCTTCCAGAGGGAAA
GGAAAGATAACAACAGTTACTGCTTTGTGGCGTACATGTGATGAATTTCATTTTGGACATTCCAGTAGGA
TATCCAAGTGGAAATGCCCAGTAAGCCTTAGACATAAGGATCTGGATCTCAAGAGAAAAATTGAGGTTGA
ACCATAATATGTCTTTCCCCTCGAATCATGTAGGTTTCTCTTTTGCCTTCTTTCATTGCCCTAAGTGGTC
CTAAATGCTACTGCTGATGCTGTCTTAGTTTGCGACTGTTGTTTGCAGACAACACCTTTTCCCAAAGGTAAT
CTGTAGACTTGCATGGATTGGGTTAAGGTGGTTAACCTGCAGCTTTGCTGTTCAAAGCTTGGCTTCCCAC
TACCAGTTTGCCAACTTAATGAGTACTTCAACTTGAGTCAAATTAGTATTGTTCAAATATCCTAATAGT
ATCCTCTATGTGTGACTCTAGGTCTTACAAATCAAGGTGTCCTTTCTCATTGAGACTTCCTTATTAATA
AAATATTTCTTCTATTAAATTCAACCTGGCACCAAGCATAGTAGGTAATAGGCACACACAATGACTGTTT
ATTGAATGAATAAAATGATTATGTTAGGGCATTCTGAGCAATTCATCCTAAGCAGCTAATTTTCTC
CTACTTCTTTTATTATAGTGTGTGTTTGTGTGTGTGTGTGTGTGTCTGAAATGTCCCATCCTACAGGT
TCATTAATATTTAATAGAAATGAAAGAAGAAAAATACCTATTAAGTGTTTTGATTTCATCCTTTTCATTG
AATTGAAAAGTATATCATTTATTCCTGAAGAGAAATCTAGATTTTGCTCTATATTAAACATTTGACATT
TATTGGTCCTTAATGCTAATATAGATACCAGCCTGCTGGTTGTCACATTCTATCTGTTTATACGAAGGTT
GTAGACACACAGTGTATGTACATATGCCTAGTTGCTCTCATTCCTTTTGTTTCACATCTCAAGCCTAACC
CAGACTGAAAAGGTTTTGAAGGCTGAGATTATTCATCACCCCATCATTATAGAAAGCAGGGCTGGCCCAA
```

-continued

| Sequences |
|---|
| GGTTCTCACAGTGGGAGCAAGGTGGATTTTAACTCTGATCAGTGTTGTAGCTCAAATATAAAAGAACTG |
| CAGCACAAAAGTCACAAGGATAAATGATCCCCTCGTTCTTCTCCCATAAAAATAAGCAGCCAATTGAAGG |
| TGGAAGTCAGTACAGTGCGGCATTCCCAGAGGCGACAGAACCTAAGATTCCATTTCTAAAGACACTGCTC |
| AACAAGAAGACCACCTGGGATGTCTTACATAAAACCATTGGCCTGGCAGCTTTTGGCTGAGTTCTCTATT |
| CTGGTTCAAGCCAGCATCACAGCCTATCTGTGGTTTTAACAACTGATGGAATTTGTATTTTGAGAACCCT |
| CATCCGTTAGCATGAAGCAAACTCAAAGCATTGTTGCTCATCAGTTGTCATCTGTTTGAGAAAGATTTTG |
| ATTTGTTTACTTGTAGTGAAGCTTGACCATACTTCTCCAGGGGCTTTTTAAAAAGATGAATGTGTCAGCT |
| TGTAGATTTGTCCCCATGAATGAAACCACAAGCAAATTCTCTTCTCTTCCAGCCTCCCTTCCTCCCTC |
| TTGTTTCTTCAGTGGCCATCTGTGCATTATGTTCCCATTGCCAGGCCCTCTTCAAGCAGCTTATCATGA |
| GTGAATTCAGAAACTTCAAATTATAAAGGACACCCAGATAATTGGCCTGTTCTCCAAAGTATCTGTCCCC |
| TGTGCTGCTGCCAGATTCCTTCTTAATGAATACATCCAGTGACAGTGGGATTCTTGAGCTTGTCCGTATC |
| TGTGAGAAAATGAGCTCTCCTGCTTTGTAACAGCTTGTGGCTCAGGGAAAAAAATGACAGCCATTGCACA |
| AGTTTCCTTTGAATGTAGTTTTCTTTCCCATAAATGATACTTTGAGAATACAGTTAAGGGGTTATTAGTT |
| TTCTATTTCATGCTTGGCCTGTGTGTGAGAATAACACAAGCTGTCACTGCAAATCAGTAGCTAAAAATGC |
| TTTGTCTGGTTAATGTGAACATTTAATATTTGGCTCAATTAAAAATTAACCGATGAAAGTACATGTCATT |
| GGAATTTGAAAATACCTTTTGTACGGAATACTTAAAGGGCATCACCCATGACTAAACCAGTGCTTTTAAA |
| ATATGGAGAATATGGGGAAATTTAATATGAGTTGGGATACTTGACTCTTTTTTAAAACCTCTCTACCTGT |
| TTGGCACAACAGGGTATTGATAAAGAGTGGGCTCATTGTTATGGCAAAGGATTCACTTGCATCTCTGTGT |
| TTTTAAGTGGGTAATTGTTTTTTTGCACTCAGTCACATGATTAAAGCAGACAGAACAAGAGATCAGTTAT |
| TCATTTATACCATACTTTTAAAAAAATATTGAGCCAGGCCCTGGGGAAGTGGGAAGTGGAGACAGAGCG |
| GCGTGGCTGATAGTCTAGGGCAGTGCTATCCAATCTTTTGGCTTCCCTGGGCCACATTGGAAGAAGAAGA |
| ATTGTCTTGGGCCACACGTAAAATACGCTAACACGAATGATAGCTGATGAGCTAAAAAAAAAAAAAAAGC |
| ACAAAAAAACCTCATAATATTTTAAGAAAGTTTACAAATGTGTGTTGGGCTGTATTCAAAGCCTGCCATG |
| GATTGGACAAGCTTGGTCTGGGGGAGTGAAGACCATTCAACATCAGCTGCAGGAGAGCATGTTTAAAGCT |
| ATGAGAAGAGATGCAGCAATAGTGGTGGCATTTATTGGAGTCAAGGAAGTCTTCCCAGGAAGGGGACTGA |
| AGCCTGAAGGATGAGCAGGAATCAATGTAGTGAAGTGGGTGGGAGGAACCAAGTGTGGCCCCAGGCAGAA |
| CTTCAGGAACAAAGGCCAGAGGCAAGCGGCCACATGGTGGACTGCAGGAGCTGAGGAGTTCAGCCTGGCT |
| GGAGTGGAGAGTGCAAGTGGGTGGGTCAGAAAGATGATGCTAGAGGTGGCCCACCCTGGAAGAGTTTGTT |
| TCAGATACGTCACCCTGACTCCACTCCAGACCGTTAATGAGACGGGGGAGAAATCAGTGACCAGATAGAA |
| GGCTCTTTCAGCAAACGGGCAAGAGATCAAGTGCCTGACCTAGAGGAATGGTAGTGGGAACGGCAAGAAA |
| TTGCTAGCTTTGCACAATGATTAGGACTAGAGTGGAGAGATTTTTTGGAAGAGGTAATGATTGACTGAAT |
| GCTTTAGAACATGGCTCAGTTCTTCCTCAGCTTTGCTGGTCTTTCTGTACAACTTGGAAAGAATGTGGTC |
| ATTGTTCTGGTTATATATAAATGCTTTTTTGTGTTTTTTGTTTGTTTGTTTATTTGTTTGTTTTTGGAGA |
| TAAGGTCTTGCTCTGTTGCCCAGGCTGGAGTGCAGTGGCACCATATCGGTTCACTGCTGCCTCGAACTCC |
| GGGGCTCAAGTGATCCTCCCACCTCAGTCTCCTGAGTAGCTGGGACTACAGGTGCATGCCACCACACCTA |
| GATAATGTCTGTCTTATCTTTTTTTGCGACAGGATCTCACTTTGTTGCCCAGGCTGGTCACAAACTCCTG |
| GCTTCAAGCAATCCTCCTGCCTCCGCCTCCCAAAGTACTGGGATTACAGGCATGGGTCACCTCACCTGAC |
| CTTATACAAATATATATTTTTCTTATTTCACTTTTAAAAAATTGTCTGGTTAAAAACTATTTTTGTTAG |
| AATTCACCGTGTGATAAATCTTTATTAACTATCAGTTAATAAAAGTATATTTGAGGAAAGAATTCAATTA |
| TGAAAGGCAGTTTTCATAGAATTTTTTTCCGGGTGAAAAAAATGACAGTGGTTTCTTGCCTTTACGTAGG |
| ATTTTAAAGTTTCTAAAAAAAAATTCCATATCTGTTGGCCCATTTGATCTTCACAACAACCCTAAGCAAG |
| GCAGATATTGTATTCCAACTTCTCCCTACTTTCCTCCCCACACACACTGTTAGTTATTTGTTTATGCCCA |
| TGTAAAGAAGAAGTTCGCCCAACAAAGGTGTGTACGAGCCAATAAGCACAGGAAGAGCTGATATTCATT |
| CCCTGGGTTGGGAATCCCGTAGATATTTCTTTATCCTGTGCTGCTTCTCTGGATATGTGTTCATAAAGAC |
| ACAAGATTGCTTAGTAGAGACTGAAATATATTGCATTTTGAAAACTAGTATACTCTACTGCTTTCTGTGT |
| CAAAAATGTTCAGGGAAATTGGAATGCAGTCTTTTGTTTCTGGTTACTTTCCCTTCTTCGATTCAGCCTT |
| TGCAGCGTTTCTCATGCTTGCAGCAGAGGGGGATCTAGCTGCTTCCATTTGGTGCCTACCATCAGCTCAA |
| GACCCTGTGAGGATGCGCTTATGAGCCAGGCGGGCTTGGACATGAGCTGAAGGGACAGTAGTAGGATTGA |
| CGTGCGAGGTCTCTAACACTTGAAGGCCCTGTAAAACAGCCCCTTTCAACAGGGGCCAATTGGAATTAGA |
| TGAACATGTGTGACTGTTTTTGCTTGTTGACACCTGACTAGCAACGGTGTTATGTTAGCATGCTGTTTGC |
| TGCCTTTATTTCTTTGAATTCCTCAGAGTCCTTATTTATTATTTTCAAAGGTTGTAATTAGCTTTAATCG |
| GAAGTGCCCGTAAGTGTAGTCCTGTAAATGTTGCTCTTCCATCTTTCTTTTTCTTTTCCCAAGAAAATG |
| CCGCATTGGACCATCAGGAAAAATAACTAATGGGTACTAGGCTTGATCGTGGGTGGATGAAATAATCTG |
| TATAACAACATCCAACAAGTTTACCTATGTGACAAACCTGTACATGTGCCCCTGAACTTAAAAGTTTAAA |
| AAATTTAAAAGGATGTGAAACAAAAAAATTAAAAGAACAAAACACTAATAAAATATGAAGAAGTCCTTCAG |
| AGTCTTTAAATTTGCTCATAGAGCATTGACTGAGACACTATCTCCTTTAGTAACTAAATAAAATTAAAAA |
| AATAACACTGGGCTCCTCTTTTTAGGTGACCAAAAATATTTGTACATGTTTTTTGAATGTTGAAAATGG |
| TGGAGCCTTCATCAGTAGGGTTTCCGCAGTAGTAAAGGGCATGTTACTGCAAGTTCATTCAATCAACAAA |
| TATTTATAAATATTTGTTTACTGTAAAGAGCCTACTCTGGGCCAATCATTGTTCTAGGGCTGGAGCTAT |
| AACAGAAAACATGACAGGTTAAGAACTCTCCCATCTCTTGTGAATCCCACATTGTGAGGAAGTCAGAAAA |
| GTAAACAACTTAAAAATTAACAATATAACATAAGGGCCACAAAGTAATGAAAACAGGGCAATGCAGTGCA |
| AGGGTGCTGATGGGACAATATTAACTTCTTCCTTGGTCTTTGAGATTTTCAAGCAGTACTACAAGTTTA |
| CACAGAGGAGATTTAATGGGTTTTCTTCATTAATAGTTGAAAACAGTGTTGTACCTTAAAAATAATAAA |
| TGTATTAGTATAATATAGCCCTTACATCAGTTTAAAATGAGTTACCATGAACAATATGAACTTAAAGAGA |
| CTTTTACTATTTTTGGCTAAAATGTTTAGCGCAATCTTTTCCTTACCTACTCATCCTTCTCATTTCCCCA |
| TTTCCATTTATGACAACATTGGTCATTGGCCTCAGTCACCGAAAGTCAGGAGGAAGGAAGGAAATGAATA |
| TTTATTGAACCCCAATATGTGCCAGACCCTGGATTTAACACTTTTAGGGATAGGAGATTATTTAACCTCA |
| ATAACCTCTCCCTGAGGGCAGGAAGTGGATTTATAGATGCGGAAACAGAGGTTCTGCAAAGTCAATTGAC |
| TTTGCCTGGTAAGAGGCAAAACCAGCATCCTTTATTTAGGCAATCCAAGTGATGTTCATGTCCTCTGGAA |
| CTTAAATTTTTAAAACAAAAATTTAAACAGAAACATATTACAAAAGAACAACTTTATGCATGTGACCTTT |
| TGGGTTCTTTAGGAAGCCAGTTAGTCACTTTATTTTAATAACTAGAAGGTGAAATCTTTCCTACAACAT |
| GTAATTTTAAGTTCTCTCATAGTTAAAAAATAAATGAAACAACTTTTTTTTTCTGTCTCCCTTTTGACTC |
| CTAGAGTCTGTTTAAATAGCCTTTGAAAAATAAGTACTAATCACTGGTTCCTACCAAGACCAGACACCTG |
| ATTCAGAAGCTCTTACAGGGGTCAGAGTGTGCGTTGGAAAAACAAACCCACAGTGCCTTCCTGGTTCCAG |
| AGAAATGATCTCACTGTCAAATTGTAACCTGCCTAATACCTTAATAAAAAGGTGGGGAAAGTCTGCGGTT |
| TTACCTCTGGTATGATCCTTTTCCCTTCACTCTTTTTATTTAGGCATGACCTTAGTGTTTTTTTCTTC |
| TAGAGTCCAGAGGTGGAATGACATGTCACTCAGGTTTACAAGATGAGGATGTATCTGTTTTTATATTCAG |

| Sequences |
| --- |
| CTGTACATTTTATTCTACTTAAAAACAAACCCACCTTCAGCAACCAGGGCGTATCAAGGGAGAGTTATTT |
| CCATCCCCCTCAGTTTAATTTGGATACATTTGGCCCAGAACAGCACAGTGTTTCCATAATAACATTTGAA |
| CAGGATGCCCTTGTGTTATTTGCAGGGCTAAGGGAGTTTCAGCATGGGCCAGGAAACTACTTTCTTAAAA |
| GAAACTTAAACGCGAAATTCTGACAAGATAGGAAACTCTTACTGCATCCTTACTAAACCTCTTTTTCCCC |
| CCTACTTTCTCATTTATTTATATATCTCTTGTGTTATGAAACATATATAGGTTGAATATTTAACTCACTC |
| TGAATTCATGTGCAGAATAAGTCACTCTTCAGAAGGACAAAAATAATGTTTTAAGTGGTTTGTTTAATAA |
| AGCACATATTAAAAAATTTCAATTCAACATCTTCCCTGGGCACAACATGTTATGACTTTTTAGAGTAGAG |
| CTTCGTGGTATTTCATAAGGAAGCCAAAAAGGAAGGGAAATTATTATTCGGGCAGAGGGACAATAGTGAC |
| CTTTCATTAAGCAAGACAGAGTTCACCATCAGGCTCCCCAAACCCCAGGCTCTGTGTTAGTTGAACTGAA |
| CAAGCCACCAACTATTTCCTCTCTCTCTTTCTCTCTTTCTCTCTCTTTTTTTTTTTTTTGAGAAGGAGTT |
| TTGCTCTTGTTGCCCAGGCTGGAGTGCAGTGGTGCAGTCCCGGCTCACTGCAACCTCAGCCTCCCGAGTA |
| GCTGGGATTACAGGCGCCTGCCAGCACGCCTAGCTCATTTTTTTGTATTTTTTTAGTAGAGACTGGTTT |
| TCATCATGTTGGCCAGGCTGGTCTCGAACTCCTGACCTCAGATGATCCACCTGCCTCGGCCTCCCTCCCA |
| AAGTGCTGGGATTACAGGCGTGAGCCACCACACCTGGCCTCCTCTCTTTTATAGACCAGACTACTTTAAA |
| AATATTCGTCCAATATTAGCTAAAATATTTCATTTATAAGACATAAACCCAACATTGTAATATTTAAAGA |
| CTGCATTATGTAGTTTTTACATATCCTTAAGATCCTAATGAATTCAGATAATCAGTATTTTTGTTCTTTT |
| AACAGCTTTACATGTGACCTCTTAGTTCTAGAGTTTGATCTCAGGAGAAGGGAAGAGTAGATTTGGATTC |
| TGTGCCGTGGACAGGCGCACTGGTTTCCCGTGTGAAAAGGACAAAGCCCCGCCCCTTCTGGAGCTCAGTT |
| CTCTTTGGGATTATTCATAATGTTCTCCAAGAAGCTCGGAGTGCCTGTTTGTCGCCAGTACTGTAATTTG |
| TGAGTAAAAGATCTTTATGATTGCAAAATACATTAGCGCCTTCGGAGATCATTGTTTCTTGATGACGGTG |
| TGAATCACAACTAGGAACTAGGAAGTCATTTCAGCCCCTTCTGTGCAGAGGGATGTCATGAAGTACATAT |
| GCTAAAGTTCATACCCATTGCTCATAAGAGCTCAGCCAACCTTCTCAACCAGTTCATGTAAAAATATATC |
| TGTATAAATATGCATACGTATGTATGTATGTGGTGTGTGTGAGTTAAGATATACATAAAATTTACGTT |
| TTCCACCAATTTTAAATGTATAGTTCAGTGGCTTTCAGCACATTTACTTTGTTACATAAACCATTATTAT |
| GTAAGCCATTACTGACATCTGTTTCCAGAACTTGTTCATCATTCCAAATGGAAACTCTACCCATTAAACT |
| ATAACTCCCTGTTTCTTTTCTCCCCAGTCCTAGGTAGCCACTATTCTATTTTCTGTCTCTATAAATTTG |
| ACTCTTCGAGGAAGAATTTGATTCTTCCCATAAGTGGAATCAGACAATATTTGTCCTTTTGTGTCTAGCT |
| TGTTTTATCTAACATATTTCAGAGTTCACCCATGTCATGGCATGCATCAGAATTTCATTCCTTTTTAAG |
| GCTGAATAATATTCCATACCATTTGCTTTTTTAAAAGTCCATTTTCTCAAAAAATTGGTTGTCATTTCCA |
| CTCCCCACCCAGCCAATAGAAACAGCAAATATATTAAATTAGAATTGACCTGACAGAGGAGGTAATGGAG |
| GCCTGTAAATTATTCAAAGAATTATTTTAGAGTCTGACAGCAAGGAAGAAGACAAAAATGCTCTTAAAAC |
| CAGCTCAGGAGTCTCTGAGGCTCTTCTGCGTGGGGCAGGCAGTCACAAGATCTCTACGGCTCCTGGAGT |
| TCTCGCTGGATCGTAGCACAGGACAATCTTAGTGATTCCTAATGATGCCACTGAGTCATCAAGACAGAGT |
| TATTTTCTGTAGGAAGAGTCAAAGAGTTCAGGGAAAGTGAGTAGTAAGTTACAGAAATATCTCCATTCCA |
| AATGGTTAAAATTTTTTAAAAGTTTAGGCTTCAGTCATCTGAAAAATTTACTTGTGTGAAATGATTCAGT |
| CCAGACTGTAGTGAAAGAGAGGAATCCCAGCAATATCAAAGTAAAATACACACACACACACACACACACA |
| CACAGAGAGAGAGAGAGAAGGAGCACAAGATCTCTTTCTTTTTTGTTTTTTTCTCTTTTTTTTGAACAA |
| ACTCTTACATATCCTTCAAGCCCAGGCCAAATGGCACCTTCTCTGTGAATGTGTGTGTTAAATAGGCA |
| GAGAGACCTTCAGGGGCGTTTGCTGACTTCTTTCATTCTTTTTCATCTCCTACCTCCCTTTCTAGAGTAG |
| AGAATTAGTAGGAACTTGACTCAAGTGGACGGGGATGTAATTTCTAGGGGGAGTTTTTGCTGTCTTACTG |
| CATCTAAATTATTCTGTCTGTGCATAAATTAAGTTGTACACATATTTAGAAGAGCCACCTCCCCCACTGC |
| AGGATGCATAGAGTGGTTTTTGTGAGGAGCTGCTTTGCAGCCTCAACTCTGCCTCCTGACTTCATTTTGA |
| AACCACTGTACAATAAAACGTGGTCATTTGTTTGTTCCACATTCTTTGTGCCTACTGGGTTTCTGGACAT |
| GATCTCTGGCCTTGGGGGGACAGTCTCCTGGGGAAACAGACACACAAACAGATCTATTACAGTCCAGTG |
| AGTTTTTTCCTGGGAAAGTTAAGGATGGTTTCACAGAGAAGGTGCCGTTTGGCCTGGGCTTGAAGGATAC |
| ATAAGAGTTTGTTCAAAAAAAAAAGAAAAAGAAAAAAAAAAAAAGCAAGAGATCTTGCTCTCTGGAGAATG |
| TGAAAGGGTACCATATGCAAATAAGGAGAGTAATTGAAGGGCCTGCCAAGCTTGGGAATGGCAAAAAGGC |
| CAGAGTGACCAGAAGAGAGGCAGTTGGGGATGGAATGGAAGGGGATGAAGCGGGAAGATAGTGGAGGCTC |
| GCTCTCCAAGGCTCTATGTGCCCCACTAAGGAGTTTGATTAGACCTTTCCTGCAGTGGAATGCCAGTAAA |
| AGGTTTCTAGCAGGATACTAAGTGACATGGCTGGATTTTTTGTTGATGAAAATACTGCTGGTAGCAGTG |
| TGTTGGTGGCACTGAGGGCAGCAAGGAGGCCAGATGGGAAGGTGGGGTCAGGTGCCCAAGTGAAGGTGCT |
| GGGCAGCTGCCCCAAGGCATGGGCAGTAGGAACTCCCAGGATGGGACTACCTGAAAAGGTGTTCTAAGGT |
| AGAATCAACAAGATTGTGCACAGTTGATCATCGCTGAACACTCAGTGCTTAGCGCAAGGCAAGCACATAA |
| TAGATGCTCAGTAATATTGACTAAATGAATGAATGCACAGGCAGCTGGGTACACATGACAAGCAGTACAA |
| GCAAGTGTTAAAGTGACACCCCAGCTATACTCACAACAGTGATAAAGCAGAGGTTCACATGGCCTGTACT |
| TTGCCCAACTCTTTCTAAACGTTCTATCACTATTCGTGTATTTCTTTCTTACAACAGTACTGGGAGGTGG |
| TGGTGTTTTTATCCTTGTCTTGCAGATGAGAACATCGAGGCTTGCAGGGGGACCCATTACAGCTGTTT |
| GGGTGGCTGGGCTGGAATTTGAACCCAGGCGGTTTTGGAGTACTTGGAGCCCTTAATTCTGTTGCTCTGC |
| TGCCGCCCAGCTTTTGAGCCTTCCAGGAAGCTGCTGCTTTCAAGGCCCCAGAAGTGATGACTCGGGGCAA |
| ACCTAAGTGGTGGCAGGATGCAGAGAAGCCTGTTTAGGAAACCATTTATCTCACGTAGACATGCCATCTG |
| AGATGACCTTAGTAGAAATAACAATGACAATGATAACAGCTCCGCAGCCTTTTCCCTGGCATAAGAAACT |
| AGTTTTGTAATGAAAATGGAATTTCTCTGGGGAATAGTCCTAGAAAAGAGATAGGTAGTTGAGATAAAAAT |
| AACAAAATATAAAATAGCATTGCATTGTTTTCTGTGTATTTTCCTTCCACCTTTGTCCTTCTCTGTTGT |
| GTAATTTACCTTGTTCCCTTGGCCATGGGTAGGTTGGGCATCACTGTGATTTGACTTTTGTCCTTTGTCC |
| CAAAGAAAGGGATGAGTGTGTGCATTTAGAGGTAGCTATTTGCACCTTGCCTGGAGCTTGCCATCAACAT |
| AGCTAGCTAAAAGGAGGAGAGGCCCTTGAGGGTAAACCTTGCTTTAGGAGTCGAAGCCCTTGGCTTTCTG |
| GAATGAAGGGTGGTGAGTTTGGTTTCCCAGATGGCCCATGGGCCAGAATCTGAGCTCCTTGGCATTCAGG |
| TGTGTGTGCCGTTCTGGATCATTACAACCACGACTGAGCTGTGTTTTCAAGCCATAGGTCAGAGTCGTGT |
| AAAATAAACTCTTGTCATAACAAAGGATGCGGCAGCCAGATTGCAGCTCGGAGTTCCTTCACTCATTTAC |
| CCCAGAGGACACTGATTTTCATGTCAGCATAGGGAAGAGATTCCATTTGTCTGCCGATTCTAATTGGGGG |
| TCTGTCTTGCTCGACCACCTCGGTAAATGGTGATAAATACTGGTGGCCATGACAGCACAGAGAGAGAGTG |
| CCGGCCTGGAAACCCAGCCAAGCTCTCTTGGCTCCAATTTTATGCAAATTTGCCTAATAGAATGCAAATG |
| ATTTCACAGGAATACGGATCCCAGGGACACGTGCTCATCGTTTTCAGCAGTGTTCCTGGGCTTTTAGAA |
| GCAGCCACTTGAGAGGCCAGGCAAGTCCACAGAGAGGCAGGTTAAAGGTGGCTTGCGAAGGAATGGCTCA |
| CCCCATCAGCCGATGCCACGCCTGGAATTTCATTATGAGCAGCGGCTTTCCCTTTGGCAGTCTGCGAGCC |
| AAGCTTCTGTGTTTTGGGAACAGGAAAAGGTCAACACAGACTAATGCTTTTCAAAAAGTCCTTTATTC |
| TTCCTGTTATTCTACAGATTTTGTGCGATCACAGTATATATCCAAACATTTACTCATCCTACACATCTTG |

-continued

| Sequences |
|---|
| ATTGGGCATTTAGTCACTAAAAGGCACTGTGCTAGGCACTGAGAAAAGGCTGCTCTGTGCCACCAAGGTG |
| TGACACCATAACATTGTGTCTAAAATCTACTCCTGCCCTCTCCAGTGCCGTGGCTGTGGCTACCAGGCTC |
| ACGTAATGTGGCCAATCTGAATTGAGATGCGATTGGAGTGTAAAATACACACCAGGTTTACTGGATTTCA |
| AAGATGTAGTATGAATAAATGAATGCAAAATATTTTATCAATAATTTTTATAAGAATTTTGTGTTGAAGT |
| GATAGTATTTTGGATGTATTAGTTTAATAAAATATACTAAACGTGACCACTAAAAATTTAAAATTACATA |
| TGTGGTTCCCATTATATTTCTTTCTTTCTTTTTTTTGAGACAGAGTTTCGCTGTGTCGCCCAGGCTGG |
| AGTGCAGTGGCGTGATCTTGGCTCACTGCAACCTCCGCCTCCAGGGTTCATGCCATTCTCCTGCCTCAGC |
| CTCCCAAGCAGCTGGGACTACAGGCGCCCGCCACCATCCCCAGCTAAATTTTTTGTATTTTTAGTAGAGA |
| CAGGGTTTCACCGTGTTAACCAAGATGGTCTCAATCCTGAACTCGTGGTCCGCCCGCCTCGGCCTCCC |
| AAAGTGCTGGGATTACAGGCGTGAGCCACCGTGCGGGCCGGTTCCCATTATATTTCTATTGGACAGCAC |
| TGGTCTAGACTGCTAACCATTTATTGCACAATGTGGTCACCTTTTTATTCCCATAGTTGGATATTACTAT |
| ATAGGAGGATAGAAAGACCTTTCCTTTTTTCTTCAATGAGCTACAGTTGTGTAGCCCTTTTTAAAGTTCA |
| TTCATATTCATGTTCTTGTGGCTCCCATTGTCAGTCTGCTGAGCTGGGCAGGGAAGGCCTCACCATACTT |
| TTACAGGTGAGCATACTGAAGTGTAAGAGGTCACTGTTGCCAGCCTGCCCTAAGAGTTAAGCCAAGAATA |
| AAACTTCAGTAGTTTCTGGGTGGACGTGGTGGCTCATGCCTGTAATCCCCGCACTGTGGGAGACCGAGGC |
| TGGAGGATCACTTGAGCCCAGGTGTTCAAGACTAGCTTGAGCAACTTAGCAAAACCCTGCCTCTACAAAA |
| CACAAAACAATTAAGCCAATCATGGTGGCGTGTGCCTGTAGTTTCAGCTGCTTGGGAGGCTGAGATGGGA |
| GGATCCCTTGAGGCTGAGATGGGAGGTTGAGGCTGCAGTGAGCCATGATTGTGCCACTCCACTCCAGCCT |
| GGATGACAGAGTGAGACCTTGTCTCAAAAAAAAGGACTTCAGTAGTTTCTAACTCTTGCCAGGCTGGACC |
| ATTACAGCTGGGTTGGGAAGGTTGGAAATAGAACTTTCGACTTCTATTCTAGTGTCTATTAAAAATACAC |
| TAAAATTTATGCATGGAAATATTTACTTTTATTTCTGTACCAAAGATGATAGAACACAGCCCACTTAGAA |
| GTATTTCTGTGTGCATGTGTATGTAAATACACACAAACATGCTCTGCAGCTGGCTAATAAAACACAGTAA |
| TCAAAGCCTATAGTGGATATTCAGTGTAAAGGTAAGACTTGCTGAATTTTGAGGCCCATTGGGGAAGGGC |
| AGGGTCAGGGTGAGACAAGCATGTGGTCACAACCAGGGGGCGTTTTCTTCTGTTGGGAGTCAACTACTGT |
| TAGGGAAAATTCCTGGCAGCGTGGAGCAAGGTTGGTGGATCCCACCTGTCAGAAAATCCTGAGACTGGGT |
| TTAGTCCTTGAGGGATGGAAGGACAAGGCAGGTACCCTGGACCAAAGAGGCAAGGGATCCAACCCAGGTA |
| GTCACCCAGCATTGGGGATGGCTTAGGAAAAAGGTTGGGGAGGTGCAGTTCTAAGGAAGAAGAGAGAATT |
| GATCAAGAAGGAGGTGGATATGGGTGAGAGCTGTGTAGTTGTTGAGGACATTTAGGGCAACGGGCCTT |
| GGGTTGTATTCTTCTGACCCGCCAGGCACTTGCTGTTTGGGCATGTCATATACTCTTCTGAGCTTTCATT |
| TCTTCATCTGCAAATGGGGAAGTTGAGTTACAGGGTCCCTCACTAACATTTTGTGATTCTATGAGTTTCG |
| AAGGCCAGAGAATCAGCAAGAATTGTATTAATAAGCTATCAATGATGGTATAAAGGTTTTGCTTCTCACT |
| GCTGCTCTTTCTGCTGTCTGATGTGCTGGGGGCACTGAGGTCTATGGCAAATGAGATCATTGGCCTGGAC |
| CATTCACTTGGCCCTTGACAGACACAAGTTGGGTCTAGGATTTCTTTGCAACTATAGCCAATACATACAT |
| ATTGTAGTATAATATCTAAAAACATTTATACCTACTTGTCTTTCTTGGTTCTCTCTGTTCTCCTTGTCCC |
| TACACTTTCTATGAATTATAATAATAATAATTATTACTATTATTATCTTTTTTTGAGATGGAGTCTC |
| GCTCTGTCTCCCAGGCTGGAATGCAGTGGCACAATCTCGGCTCACTGCAACCTCTGCCTCCCAGGTTCAA |
| GCAGTTCTCTGCCCCAGCCTCCTGAGTAGCTGGGACTATAGGCACTCGCCACCATGCCTGGCTAATTTTT |
| TTTTTTTTTTTGGTATTTTCAGTAGAGATGGGGGTTTCACCGTCTTGGCCAGGCTGGTCTTGACCTCGT |
| GATCCACCCACCTTGGCCTCCCAAAGTTCTGGGATTACAGGTGTAAGCCACCGAACTCAGCCAAATTATA |
| ATTATTTCTTATCTCCTATCTTCAGAGTCTAGTGTTACACAGATAGTAATTCTCCAACATTGCTCATATG |
| ATTTAGTAAATCACTGCATGTTCTCGGTTTAGAAGGATTTTCCCTGTCTTATACCTTCTATGAATTAAAA |
| AGCTTTTGGACCATGGATGAATGACATAAGAATTTAACTACTTTTTTTTTTCTTTTCTTTTGAGGCGGAT |
| TCTCACTCTGTCGCCCAGGCTGGAGTGCAGTGGTGTGATCTTGGCTCACTGCAACCTCAGCCTCCCGGGT |
| TCAAGTGATTCTCCTGCCTCAGCCTCCTGAGTAGCTGGAACTACAGGTGTGTGCCACCACACCCAGCTAA |
| TTTTTTGTATTTTTAGTAGAGACAGGGTTTCACCATGTTGGTCAGGCTAGTCTTGAATTCCTGACCGCAA |
| ATGATCTACCGGCCTCGGCCTCCCAAAGTGCAGGGATTACAGGTGTGAGCCACCCTGCCCAGCCTACTTT |
| TTCTTTTTAAAGTATTTATTTTAATTGGGTTTCGTAAATGCAGGGATACAAAAGCTATTGGATCTTGAGA |
| TAGCTTTGTATTTTGTAGAGAATCATCCCAGGAGCACATTCCCTCACTGAGGGTTCCAGCCACCTCTTCC |
| GCCTCATTATACTTTGCTTAGCACCGAGAAGTCTGGCATCGTTTCTTGGATGAAAAGATTGGCAGAG |
| CTGCCCTGGACAACAGCACTGCAAAACACTGTGGCAGAAGGTTTGGTCTACATACCAAGGCAGCCAAAGT |
| ATTAATTGCATTCTCTGTGATCACAAAATAAGGCGCTGAATTATTCTTCATGTTTTAAGAATGACAGG |
| CTTTTGCTCTGCCAGCTCCAAGCATAGTGCATCACATGGAAAGGAGATGCTAGATTTGCAAAAAAAAAAA |
| GAGAAAAAAAGCACAGGAGTGAAGATCTCTGGTAGCCAGCTGCTTCCTAAAAAAGATTTAAAGCTGACT |
| GTTGCATGAGAGGTACCTATAAAAGATCAGGAGCCGGGTGAGGAAGTGTTTCCATAAATTTACATACTCT |
| GTTAAAACATGTTCTATTTTGGAATCTTACTTTAGATTTTGAAATGGGACTTTTCACGTTGCTGGCTATA |
| CTTTGATCCCATTTTCCTTTGTTTTGGTGTATTTACTGGAGAAAACTGGTTATGATATTTCTATATGTAC |
| TTGTCTCCCCCCAGCCCCAGAACAAGCACCATATGTGAGTATTCCAGATATCCAAGGTCCTCTGGACACC |
| CCAGTCTCTTCCACAAAGCTGCCTCCTCAGAGCCTGCTGTCCCGTCTTCTAGGAATGTACCCATTTGAAA |
| ACCCACACTCACACTACCACAACACATACACTGTTTCTTGCTGGTCGTTCCTTTAATCTCAGTGGAAGAT |
| ATCTCATAGAGAACTGTTGGTGATTGCTTAACTTGGTTGGGAGGAAAATAGATCAAGCAGGTGACAACCT |
| GCATATTGGGGATTTTCCTATGCTGAAAATTGTTATTCTGTTGCAGCACTCCACCCTCCCTTCACAGCCC |
| CAAAAAAGAGAAGTACGAGTGCTGCTGATGTTCAGGGTTTGAATATGTTTTGGTTTAAGATGTTCAGTGG |
| AATTAGAGAGAATTTCATCCTGGGCAGTGCAGTCAGGCTGGAGGAGTATTTTGGTTTCATATTACTAAAC |
| CTTGTTTTCCCATCCCAGCTGCTTGTGTGCTATCTTGGGGCACTGAGAACCTGGCTGGGCTCTGCGGGG |
| TGGGAGTGTTGTCCCGGGGCTGAGTCCAGCCAGGGGTGAGGTCGTCTTGGTGCACATCTTGCACGTTGCA |
| TGAAGCTCAGAGCCCAGCTTGGCTCTTGTGAACTTCCCCTGTGGGGACACACCCTCCAACCAAAGTGAGG |
| GTCCAGCGGCCACCAGGTTGTGACATGAGAGCCGTCGCTATTATTACTCATCACCTGCAGCAGGAGGAAG |
| GGTGCCCAGACCACAGAAATCTTCTGTCTCTGGGCCCGTGCCTACTGCAGTTGGCAGAGAGCTCCTGAGC |
| TCCTTCCCTAATGCGTGGTGGGAGAGCGCTTTCTTCAGCACTTTCTTCACAGGGTTTCCTGCAGTGGGAG |
| TCTTCCTGATGCTCTTTACCCCCATACTTATTTCACTCCCAGAATCAAGGAGAACTGTTAAGCCATTCCT |
| CAGTACGATGTGTCATGGCTGAAGAACCATTCATTCAAGACATTGGTGAAGAGGGTTCTTTCATTGCCTT |
| TCTTCAACGACGGTTTATTTGCTGTCCATTTGCTGAGCACCTGGGTGGTGCCAACATGAACCCATTTCCT |
| TCTGTGCGCAAGCCCCCCCTTTCTATTACCAGAGTGCAGATCCCAGCTAGCATGGTACGTGTGAGTGCGC |
| TGTATAAAGTCTGGAACCACAATTAGAAAGGAAAGCCTTTCTAAAGGTATTTTGTCTTGATATTCATTAA |
| CCTATTAGATTGCCATTCTTTCATATCTAAGATGATCATAACATGTCTCATCCAAGCTGAGACACTTGTT |
| ATTAATCATTATTCTGGGACAATAGGGTAGGCCAGGATGGTCCCAGGCAAGCTGATGTCTAGAGTAATAA |
| CCCTGCACATATGAATCTTTTGAAGGATTGGGCATGATTTTTTTTTTTTTTTTTTGCACTGGGGTTG |

| Sequences |
| --- |
| GCTGGGGCTAGGAGTTTGTGATGAATCCTTCCAGTATTTTTCTGAAAACCAGTGAACTATTTTGTAGGTT |
| TCTGTGTCGTTAGAAACATGCAAACCTATCCACTAAAACCACTCCAGTTGATCTATTAAGTCATTCGTTA |
| GGTCTTACCTGGACTCTCTTCACTGTCACTATCATGATCTGTCCACATCACTGGCCCTTTCTCCTATCAC |
| CTAGCTCTCCTGTGAGCCCAGCACTGATATAAAGTGGTTTCTAGTCTTCTTGGACTCTCAATTTAACTTG |
| CTTCCCATGGGAATCTTCTAACTGTTTCCCCAAACCACCTTGTAGACATTCATTTCTTTGTTTAGGATTC |
| TAAGAATAGGAAAGAGAGACATAAGCTAGATTCCATTCCTGTTTCAGTAAGATTATCTTTCCAACACAAG |
| AAAGGAATACATCTAAAAAATTCTTTCAGCATTTTTTCCCGCTTTATTGAGAAAAAAAAAAAAGAAATA |
| CTCATGAGTACTCCAGGGCCTCGGTTGATAGTGTGACAAAAATAGTTCCAACTAAACTAAGTAACTCAAG |
| GCTATTTGCTTTATCTTTGTACTCTTTCATGTGTTCCCGAGTCTTTTACAGATTGGGATGGTACACTTTG |
| GTTTAAATTGCAAACTCTTGTATTTAACTTCCTCTGAATGATTCAGGACGGGCTGTGGACCTGTTGACA |
| CTTGATGAGTATTGGTTTCTAGTGCAAATGATGACCTGTTGAAGGGCATCAGGCATATCTGAAGGTAGCT |
| GTCCAACTAGGTCACGTTCCCATCAACACTGTATTGTGAATCTTTGGTAAGAAGAGTGATAACTTTTTGC |
| AAAATGTAGTTTTTAAAAATAACCGTGAACTTCAGTGTCCCCAGTCAAAATAATAATTCATTTGGGGAAC |
| AATTTAGAGATTCTTTCGACAAATACAGAGAAATGGAAGCCAATCATATGCGCCTCAAGCATTTGATATT |
| GGAAGAAAATCAGCATCTACTAAGTAACTCTTGTGAAAACCTTATCCATTTTTTGCTTTTTTGCACTTTT |
| CAATCTGCAGCATAAATTAGGCCACAGGAAAAGGATGGCTACCTTCAAAGAGCCAGTTGGGTTGGCTGT |
| GTTCTTTCTATTCGTGAAAACAGCTGTGGGTGCCGGGTGTTGAAGTCAGGCTTTTGTTCCATGCTAAGG |
| TAGGAAGGTTTGTTCTTGAGACCTATCACTCTTCGTGGAGGAGGAGTTCACAGATGGTGAGCCGCTTTA |
| TCACCATCTCGGAGGCTTTTGAAATATGTTGATAATGACCTGGGAAAGAGGGCCGAGTGGGATGAGGGTG |
| GGAGTAGGAAAGAAACATTCGGCCCACACAGTGTTCATATCTTCTCTTGTTTTTGTATCTGTGGCAACTG |
| CAGATTAAATGAATTAGGTTATTCTTTTCCATTGCCTTCTACCAAATAGAAGTACTTATTTAAGCCTTGC |
| AGATTTTTTCCTGCTGAGTGAAGCCTGAACTGAGCCCATGAAAGGTGATCTCTCCAAAGCAAGGGCTCC |
| TGTTTCCTTCCTTCCATCCTGCTATCTCATTCAAGTGAAATTCCTGCCATGGCATTTATCCTGAGCTTTG |
| TCACACAGGATTACTGTGATGGTCCTTACTATGAATGGAGTGTTAAGGTGTTTTCTTTAGCTCGAGATAA |
| AAACCAGTTTTAGGAATGAATTCTCTTTTGCTGTGAAAAACATGTTCTAAGGGAACAAACCTCGCCTCAT |
| TTCCATTTTTACATTGAGCAAATGGTTGGGAAGTTCCTTTAATACTGTCTGTCTTGACTCATTGTCTCAC |
| TTTTTTTTTCCTGATTCTCTTGTGCGGGACCTTTTTCATCCCCACAGCTTCCGTATCGTCTGTATGCAGC |
| TGATTCTCAAATGGGTATTTCTGCAAATTCCAGTTCTGCTTATATACTATTTCCTGATGACCCTTTCTAT |
| CTGGACTTCCTGTTGGCAGTTCAAATTAAACACATAATCAAAATATTTAATCCAAGACTAAACTCATCGT |
| CATCCCTCCAAAACCTTCCTTGGACTCAACAGTTTCTCTTCCTGCTCTCATCACTATTCCGATCACCCAG |
| GCTCAAAACCTAGGGTGCATTCTTCCAGCTTCTGCTCAGGTTTTGAGCCCAGCATCCTTCACTGCCCTC |
| CATTCCTCCCTCACTGGTCTTGCTGCCACCACCTTCTTAACTCTTCCCTAGGGGAATTCATTCACCTGCT |
| CCAGTTTCTCCGCACTCCAGTTTATCTTATACTTTGTGATGATTTAATTAAAATTCTTCCCTGATTGTTT |
| TTCTTCTTGAGGTGGAGTCTCGCTCTGTCACCCAGCTGGAGTACAGTGGGACCATCTTGGCTCACTGCAA |
| CCTCCGCCTCCCAGGCTCAAGTGATTCTCCTGCCTCAGCCTTTCAAGTAGCTAGGATTACAGGCATGCAC |
| CACCATGCCTGGCTAATTTTTGTATTTTTAGTAGAGGCGGGGTTTCACCATGTTGGCCAGGCTGGTCTTG |
| AACTCCTGACCTCAAGTGATCCACCTGCCTTGGCCTCCTCGAGGGCTGGGGTTATAGGCATGAGCCACCC |
| TTTTTTTTATTTTAAGGCTCCTCTTTTCCTAGGTAAGTCTTCATTTTCCTTTATCCAGCTGTTCAAATTC |
| CTCTCTCCATCTTTCACTGCAACCTATGTGACATTTTCTTCATCATTCCTGCTACTCCTTAGCAAGATT |
| GCTATCTCTGAACCCGCCCTGCCTTCTCTGTTCTGGGGATCTTTTTCCTGCTGTTTTTACATCCCAGAG |
| TATTCTGTTCCCATCAGAATTCTCCATCCCTTAAGGCOCAGATCTGATCTCACCTTCAGGATGACAGTAT |
| CCCTGTTGGGAGTGACCCCGCTGATTTCTAAATCTTTACCACCTTTTCAGCCTTTTTCTTTTTTTTGTG |
| CCATTTTTCCAGGCCTTGTCACATGCTCTTTGATATTACTTTGATATACAAATGTTTGCTATACTTTTCC |
| TTCTTCCTCTTCCAGGTTATAAACATGTTGAGGCCCGGGGCTGTTTTCTAAGTTGTTATTTTAGGCTTGT |
| GTATATCCACCACCATGCCTTAAAAAAAGGCCTCACATTAGTAAGAGCTCAGTAACATTTGCTGAATGGA |
| TGAATGAAGTATGGTGGCTTTGCTATCTCTTACTTTACTTGTTCACTTCTCTCCTAGCTTCATTCATTCA |
| TTCATTCAACAATTACATATTGAGAGCCTATTATGTGCCAGGCACTGTGCTACGCATGTAGGTTTATCAG |
| CAAGCAAAACAAGATCCCTGCCTAAATGTGCCAGCATTCTAGATTCTTCCTTAGACTCACCATCTTTGCA |
| TTCACTTTACTCAGCTCTTAAAGAAACAGTAGACAGTTATTGTAAATACTATTAGCTTTATATTTATGTT |
| GTTCTTCTGTGATTAAACTTTGCTGCCAAGAACATTATGCTTTCTTGGTAGTTTGCAACTTGAGTTTCTG |
| ATTCTTAAAATTGGTTGCATATCCCAATGGCTGTGATGGTGTTGAAAACTCTACTTCTTTTCTCCCCTTG |
| ACTGCTGAACCAAATCATTTTCCAAGTTGCTCTGAAATATGGACAAAAGACTCCTTGATTTCAGCCCTAT |
| GTGCAGCATGGAAACTTTCACTAGGCTGTGCCTACTGACTAATAGCAAGTCAATGCCCATCTTCCCTTGG |
| TTGCTTGCTAAATATTCTAAAACGAAAACAAAACAGCAGTGAATTATAGCCTAGCATCAGTAAGAATGGA |
| AAACAACTGCTTTTCAAAGCTTGATTTGTATTGTTTTTAATAAGGAAGGAAAAGCTTTGTTATATAAACA |
| CATGAAAATATGGTAGTGTTCGTGGCAAGTATGTTAATGGATAATGTGCCTAAAATCTTTGCTGGGTCAG |
| TGTCATTCCCTCTTTGTGATGCTGAAGGAAAGTCACAAAAGPAAAACAACTCAAGAGAAGCTAATGTGTC |
| ATCTTCATGTAGGGATCTGTATTCAAAGTTCTTTTTCATTGTAGCTGTAATGAAACAGTATTTGTGGAAA |
| GATATTGCACTCAATGCCAAAACCCAACAATTTTGTTTTCAAATTCCTAAAAACTAAAAAAAGAAATCTT |
| GGTGACATAAATGTTCCAAAATCAAAATGTCCAAAATGAACTCATCAACTTCCTCCTCTCGCCTGCTCAT |
| CTATGTCTGTTCTGTCTGCTTAATGATATCACTGTCCACCCAGACAGAGCCCCAAACTCTTAAATCATTT |
| TCAACTTGGTTTTCTCATCTGTGAGATAGAGCTTTCCTGGATCATCTCTTAAGATTCTTTCCAGCCCTGA |
| AAGTCTGCATATCTGAGTTCTTCACTCATACTCCCCACATATCTGAATCCTGCTTCTAAAAGTCTCTCTT |
| CCCTAGATCTCTGGTTTTTAGGTTTTTAAAATTATTTTATTATTTTTTATCCTGCTGCTGCTGCTGCTC |
| TAATTCAACCTCTCATTCCTTCTTGCATATGCTGTAACCTCCTAGCCAGTCTTCCTGTCATTTCAAAAAT |
| TATTCTTAAGTTTACCTACAGTAAAATTCATCATTTTTGTGTAGCTTTGTGGGTTTTGATAAATGAACAG |
| AGAGGTAACCACTACTCTAATCAGTATACAGAACAGGTCAGTCACCCCCCAAACATATTTCATGATGAGA |
| GTTTGTACTCAAACTGCCCGCCACCCCCTAACCCTTAGCCCTGGCAACTTCTCTTCTCTTCTATATCCCT |
| AGAGTTTTGTATTTTCCAAAATGTCATAGATTGGTATCCTTCTCTTTCAGCACCTGTTCCCAGCCCATCC |
| ATCCTCTTCGTCAATGCCATTTATCTTCCTAAAACATCTCTGTTGAGCACCTTGAGAAACACTTAGTTTC |
| TCCAAGCTTCAGTTTCCTTGTTAGAATGTGACCCAGCCAGATATAAAATAAGGAGCATACAGAATTCTA |
| ATACTTTCTAAGGAGGTTGGTTCCTGAGGAGGACCCTTCATCTTGCTAACTGGGGCAACTGATGGGCAGA |
| TCAGAGAAGCAGGAAGTCACTCTGAGTAAGAAATGGTGGCCTAGAGCTCTTGTGAGAAAAGGGATCCAAG |
| AAGGGGGTAGTAGAGAGAGAAGTGAGAGACGGAGAAAAGAGAACAACTGCCACAAGAAGCAAAACGCTGG |
| AGAGGGACAGATGTCTACAGAAGATGTTTGGGACAGTTTTGCTGTTGAATGAGTGCCAGTATCCTTCCA |
| TAGTGGCCTCGGGAGACCTGTAGTTCAGACCCGTGTTGTAGGAGGTGTCTTTTGAATGGGTCTTATTTTG |
| AGGAGGGACCCAGGAGACCCAGATCTGCAATGGGGATAATGACATCTGCTCCATGCAATCATCATGTGGG |

-continued

Sequences

```
GATCATGGGGTAGCAAGATAGGACCCTGCCTGGCAGAGATTGGGCACCAAGGACTCCCTTCCCACCATCC
TGTGCCATCTCTGCCTTCTCTCCTTACTTCTTGCCTCTCACCTGGAAACTGCCGCAAACCAAATCCTCCT
ACCTCCCCTTCAATGACCTTCAGAATGCCAGCCCTGAAGGTTGGCTCAGAGGTCATTGTATACCAAGCTA
CAGAGTTTGGTGTACAGCTGACCTTCAGGGCTGGCACCAGCCCACTTTCCAGTCTACCTCCCATTAAAGT
TCTCTGTCCTCCTTACTTTCTGCTCCCAATCCTCGCCCCTACTCCTGCCCTAATCTTACGTCCCAGCTAC
GTTCAACTCCTTTGTTGAACCCTCCTGCCTCCCCTTCAATGAAAATTAACCTATCCTTTGTCTACATTCA
TTTCATGTTTATTCATTTTGTGTCTACATCCATTTTCTGTGTATATATACAATAGGTTTTGTATCATAAT
TATTCATGTCTGTTTGGACACCCCTGCCCCCAACTGTGTAAAAGGTGCTCAATTCATATTTGGTTAAATG
AAATGAATTCCTAAATAATCACAGCAAGTTTGAACCTAGTGAAGGAAGTGTTAAGGCATTTCTTTTACAT
TATGCTCTCATTTTAATGTACAAGTAGCATGCCAGCTATGGGGCAGGTTTTACTCTTCCAGATTTCTTGT
GGTTGTCAATGCATCAGGCAGCCTGTTTCCAAACAGCTGCCATATGGCCAAAGCTCCTCAAGTGACCCTT
TTATGTGTATAAGAGCAGGACATAGTTCAGATATACCCAGGAGAAGTAAGGGCATTGAAAACCTCCCAGG
CTGCTGTTGCAGAAAGGACAGGGAGAATGCCACTACCTGGAGGTGGGAAACTGGACGTTGCTATACCTGC
CCCTCCATCACCATCACATAGTTTGTGTGCTGTCAAATTTAAGTTGCCAACACAAGCCATGGACCACAAA
GACATGCTTGCTAAATCAAGTTGAGTGAGATGCACTTCTAGTACTTTCCAAACCCATGCTGAGATGCAGA
ACCCCCAGCCCCATGCAGACAGATTTGCCCTGCATGGAAACGGTGCACCCTCTCCCGCTACACACTCAGA
GATGAGAGATGAGCCTGTTTGTGAAACCAAACTCAGGATTCTGTTTTTGTGTAAGAACCGTACCACATGG
CTGACATATGTTCAGTCCATGGCTGGCAGAAGCCTCCTGAACACATCCCCCATCCAGTACCTCCCCGGCA
GTGACCCATCTCATATTTGCATATGTTCCCCTGTCACAAGATTGTGGGGAGGGTGCAGTTTGCAGCTGAC
TCCTTACCTAGCTACAGCTCCAACTAAGGGCGTGCATTCTTGGGGAGATGTTGGGAGCATCACAAGGTCC
CCTTCCGTTCCCAGAACTCAGTTTCAGAGGTCAGCCAGAAAGAGAATTCCAGAGGTCAGCCAGAGAGAGA
AGGTAGCAAGGACAGAGCCCCTACTGAGATTTTTCTTCCCACCCATCCCATCTCCAGGGCAATGGTCTTC
AGCAGGGAACAACGGGCCCTCATTCCCTGCCAGGGGAGCTGAGTACACACAAACTGCTGGATGGGCGAGA
AGTTCCCCCAGTGATCTTTATTTTTCCGTTTAGAAAGAATCCTTTATTCCAGCCCCTTCTCTCCAGCTGCT
GCGTGTGAGCCTGTCTCTGTCTCTTGGGTGGTGCAGCTGCAGGTGAGCCAGCTGTGGGCGGCCTGAAGG
ACAGCGAGGTAGGGAGCCTGGTTGTGAGGTCTCTGCTCCCTGGGGATGCTCTGCAGCCTTTTGCCTGCAG
CAAGTCTGAAACCTTCCATGCCTGACTCCCCCTTTCCATTTTTTTCCTGGCGTCTGCCCTTGCTGGAGTG
GAGCATGGTGGGAGCCAGCCCCTGGAGCCTTCCAGGATTCTCACAGTCTGTAGCCAGAGCTGTGTAGGCC
TGACCTGGGCCCAGCGGGAGGAGGATTTTGAATAAAAACCAGTGGTTCCTCTCCGTCCAAACCCCCCACC
CCTGGAATACATTGCAACCAAATATTTACTCAAGGTTCCCCCTTGCCATTTAAAAATAAGATGCTTCACC
TACTAGCCTGGCGGTGTTCTCTGCTCTGAAATTTTATGCTCTTGAGTCATACATTTGAAGGTAGCTTTTT
TTGGATTTAAAATTTCAAACTAATGAAGTTGTTTAAAGTACCCTGTCAGGTGCTGGGAGCTGCTTAAGCA
TTGCCACATAAGCACTGCAGAGGCTGGGCTCTGGCGCATACATGCCAGGCAAAGTCTGCCTTGTTTCAAAT
AACCCCAGGAAGAGTCTCTCTACCTTTGGTGCAATTCAGATCTTAGGAATAGGACTTCTGGGGTCCCCTG
TTTGGGGACTGTGCTTAGCACACACTTGGGTCCTTGCATGAAAGCCTGCAAAAGTATACGTGACTTCC
TCTCTTTTCTCCTCAACCACTGCACCCCTATTTTGGGGTATTCTTTAGACTTCTTAGTGGGGAGGCAGAGG
TGGTTGATGATGCGCTCCCAGTCAGTCCTGTCTACCTTCTTCTACCTCAAAGGGCTTCCATTAACATCAT
CCAGGAAGTGTTATAAATCCTGCCACCCAGGCCACATCTCAGACCAATTTAATAAAAATATCTGGGCTGG
AGAGGGGAACCCAGGAATTAGTATTTTTAAAGCTCCTCAGAAGTGCCCCCAGGCCAAGGCTGCCAGCAC
CATATCCATTCGTCAGCGCGCTCAGGGACACACTGGTACCCTGTGTGCTGACCTGCTGCAGTTAGAGTGA
CAAAAGCCGGATTTTGATTGTCCAGAAAAGTAAGGGTTCTTTGCTGTCGCTCTGGAGTCTCCAGTCAGAT
TTTCCATTGGAATAGGAAACAAACGCCAAGTTTATTTTAAAAGTGCTCTTGATCTACCTAAAACTAGGAA
GCAGGAAGAATCCTCGGGGAGCAGTTGAGTCTCACATTTGAATGTGTCTTTGCTTCCTCTGAACCAAACT
TCATGGTTTCATCCATTACCAAAGAGGCCCTGGTGACTTAGGAGGGATAGAATTGAACTGAAAATTCCGG
GATCGCTGGAAAAGTGATTTAACCAGTTTTTCACCACATAGGGAAGGTTATTTGGTGAGATAACAGACCT
CGAGGCCCTGCACTCTTCTGCGTGTGGTTCTGGGTTGGGATACGGTTCCCATGAGCAGAAGATCATTCCT
GGCTGATTTTGTTCAGTGATTATTTGTTTAAAACTTTAAAAAGAAGAAGCGCAGATACAGTACATTTGTA
CTCAGCTAGCCACGCAAACATCTTTAGGCTAAGAATAATAAACAACTAAATTAGTGGTTTGTTTATTAC
CAAACTGGTAGAGTTTCACAGGCAGGAAAAGACGGTACCTCCCAGGCTGGAGAAGGTTAAGTATTTTTGT
CAAGGAAGATTAAAAACCCTAAAAGCTTTTGGTTGAATTTTACTGAAATCAGAACGTGAATCCATTTGAG
AGCTAGCAACCAAAGACCCGTAGAGGTGACATGGAATGTTTTTAATTCTGAGAGATGGGCGTTTCAGAAC
TCGGAAAATGACATTTGTTTTGACATTTGGTATTTTGTTGCCATACTTACTGCCTTTAGTTCTTAGTGG
AAGTAGTTTGCTGCTCCTAATTACCCAAAAGGCAAGAAAAAAATAACTAGAAATTTTTCAAAAGAGGGGA
AATAGGTCTTGAAAGTTTCATTAATTGCAAAATGAAATTAAATGGAGCATTCAATAGAAGTACTTCTCAG
AACCAATGGAGAATTTCTCAGAAAGAAGCCCATTAAAGCTGGATTCTCTAAAGCAGTGGAAATCCCAGGA
ACAAAAGCCAAATGCCTGGGAATTGAGTTTCAGAAGAATTTTTGAATTGGTACAGATCAGTAATTTACAA
AATGGAATGGAATCACTGAATGTTCTAAAATCTGTTCAGCTAAAATGGGATAATAAATTTAGCTTACATG
GACCCTGCACATTCAACTTGTGCTATTATGATATATATATCTATATATATTTACTGCTATTTATTAAGCA
TTTTCTGTGAACCAGGGCCTATATTTTGACATACATGATCTTACTTTGTCTAATTACAAAGATTCAGTGC
CTTTCACAGAAGTCATTAGTAGATTTTGGGAGGGTCGTGTTGATGACTTTTGGTGTTTTGAGTAAGTAA
AATGTGTAATGGCATTTGAGATATTGAATGCTTGTTAAAGCTGACCTTGAAAATAAGATTTTCATTCCAT
TGCCGTGCTTTACAAATCAAACTGCCATTTAGGAGGGAAAAAAGACAAATAAATGAAGTCAACTTTCTTT
ATTTCTTAAACCATGGGTTAAACTGGGTATTTGGACAGATCGTTTTCAAGGCCACTATAGGATACTTCAG
GCAAGTATTTTGAAACTTGAAAGCATTTCTGATAAACTTCCAGGGAAAATTCTGATCTTTTGGTCCATGA
GAGAAATAACTGCTAGTTACAACTCTGGATTGGAATCGCAGTTTGAAGATAATCAGAACTGCAGCTTAAA
CATCATCAAAGAGTGACCTGTAGCTTAGCTTTCTTAATTACATGTGTCAAGAACTTGTGATAACAGACCT
AATTGAAATGACTTATTGAGTCAGGTAACATTTATGCCCTTTTAATTAACTATAATTTTTAATTTACCTG
ATCAGCATTAAGCTCACTTTAGCCGACAAAAGGCTATGGGCTACAGTCAAATTGCAAATAGAATACTTAG
TAAATGTGATAGTATTAGCTCCTACTATGGACTAATATTAGTTTGGTCTTGACCAGAAGAAATCCTTGTG
CGTATTTATGTTGAAAGATGAAATAACTTACTGAAATTGTTAATGAAGTATTGGATAAGCTACTTTAAAA
ATAACAAACCCGACTACCAGCAACAACACAAATAAACAAACCGTCAGCCTAAGGTGGACATGTTGGCTTC
TCTCTGTTCTTAACATGTTAAAATTAAAATTAACTTCTCTGGTGTGTGGAGATGTCTTACAATAACAGTT
GCTACTATTTCTTTTCTTTTTCTCTTTCTTTCCTCTCTCTTTTTCTTTCTTTCTTTCTTTCTTTCTTTCT
TTCTTTCTTTCTTTCTTTCTTTCTTTCTTTCTTTCTTTCTTTCTGAGACAAGGTCTCAATTTGTCACTCA
GAGTGAAGTGCAGTGGCATGAACATGGCTCACTGCAGCCTTAACCTTCTGGGCTCAAGAACTCCTCCTGC
CTCAGCCCTGCAAGTAGCTGAGACTACAGGCACGTGCCACCATGCCCAACTAATTTTTGTATTTTTTTGT
AGAGACAGGGGTCTCACTGTGTTACCCAGGCTGGTCTCAAACTCCTGAGCTCAATTGATCCACCTGTCTC
```

-continued

| Sequences |
|---|
| AGCCTCCCAAAGTGCTGGGATTACAGGTGTGAGCCATCACGCTTGGCCTATTGTTAGTATTTTTAATAA |
| TTTTTTTAAATTGTGGTAAAATGTATGTAACATAAAATTTATCATGTTAACCGTTTTTCAGTGTACAGCT |
| TAGTGGCATGAAGTTTCTTCACAATGTCATGCATCCATCACCACCATTTATCACCAGATTATTTTTTCT |
| TCTCAGACAGAAACTCAGGATCTGTTCAACAGTAATGCCTGTTCCCCCACGCCTGCAGCCTTGGCAACCA |
| CCATACTACTGCCTGCCTCTATGAACTTGACTACTCTAGGTACCTCGCATAAGTGGACTCACACTTGTGA |
| CTGGCTTGTTACACTAAGCATGATGTCTTCAAGGTTCATCCATGTTTTGGCCTGTGTCACAGCTTCCTTC |
| ATTTTGAAGGCTGAATGATATTCCATTGAATGGATCTACTACATATTGTTTCTCCGTTCATTTATTGATG |
| GATACTTGAGCTGCTTCCCCTTTTGGACTAATGTGAATAATGCTGCTATGAACGGTATGTACACATATCT |
| GTTTGAGTGCCTGCTTTCAATTCTTTTGAAATTCCACTTCCAGAAGTGGCATTTCTGGATCCTATTGTAA |
| TTCTATTTTTAATTTTTTGAGGAACCATCATACTGTTTTCCATAGAAGCTGCACCATTTTACATTTCTAC |
| CAGCAGTGTACAAGGGTTCCAGCTGCTCTAATTCCTGACCGATATTTCTTATTTTCTGGTTTTTCAAGAT |
| GGCCCTCTTCATGAGTGTGAAGTGGTTAACTTATTGTGGTTTTGATTTGGATCTTCCTAGTGATTAATGA |
| TGTTGAGCATCTTTCTTATGTGCGGATTGGCCATTCATTTATCTTGTTTTAGAGAAATGTCTGTTCAAG |
| TTCTTTGTTGATTTTTTAAAATCAGGTTGTTTTGTTGTTATTGAGTTGTAGGCGTTCTTTACATATTCTG |
| GACGTTAATCCGTTATCAGATATACAATTTGCAATGCTACCATTTCTTGAGGCTTACAGTATGCCAGATG |
| TTCTACTAGGTGCTTTATATATAGGATCTTAATTCATTTTACAACCCTGAGAAATAGATATTTATCACCTT |
| CATTTAATAGATACGGAAACTGAGGCTTTGAAAGTTTAAATAACTCATTCAAGGTCATACAATTAGTCAG |
| TGGCAGGGGTAGGATTGGATCACAGGTATGTCTCACTCCAAAGCCTATGATCTCATGCAGTTTGGCATGG |
| ATACTCTTCTATCTTTTTGATTTATGATTTTCCTTCATTTAAAAAATCTTTTATTTAGAAGTATAATAAA |
| TATACCAAAATGTAAATAAAATATAAATGTATATCCCATTGGGCTATTTTAAAGTAAACACTTTGTAGCC |
| ATCATGCAGGTAAAAGAAACAGGGCATTGCCAGCCCCCATAAGGCCATGTCCCCTGACAATCATAGCCCT |
| GTATCTTCCACCAAAGGTAGAAATTATGTTAAGTTTTATGGTAGCCAATTCCTTACTTTCCTTACACATT |
| TACCACCTAAGTATGTCACCCTAAATGATATAAATTAGTTGTGCTTGTTATTTAACTTCATGTAGATGAA |
| ATTGTAGTGTATGTAGTTTGTGTTTTGGGCTTCATTTGCTCATAGTTACGTTTGTGAGATTTCATGAAGC |
| TAAAGTTTGTTCATTTTCCTTGTTGTATTTTATTGTGAAAGTTCACCCACTGTATTTATTCATCCTGTTG |
| TTTTTGTTATGATATATAATGCTGCTGTGAACATTATTGTACCTGTTCTTTGGTGCCTTGTGCATATATT |
| TCTATTGGGAACACACCAAATAGTGAAATTGTTGTAGATGTAATGCCATGTATGAGAGTTCCTGTTGTTT |
| TGTATACTCTCCAAACTTAGAACTGTCAGTCTCTTTAATTTTAGCCATTCTGGCATGTTCAGAGGAGTAT |
| CACATTGTGGGTTTAATTTGCATTTCCCTGATTACTTATTACTAATAATCTTTTCATATGCTTATTTTCT |
| TTTAGAACGTGCCTATGCAAGTCTCTTGTCCATTTTTCAACTGTTTTCTATTTCTTATGAATTTGTAGGA |
| GTTCTTTGCAGCTTCTGGCTATGCATCCTTCATTAATTTTGTGTGTTGCAAATATATTCTTCCATTTTGT |
| GACTTGTCTTTTTAGTCTCAAAACAGAATCTTTTGATGAAAAGAATTTCTTAATTTTGATGTAACCTCAT |
| TTATCACTCTTTTCCTTCATGGTTGGCACTTGTTGTGTCTTGTTTGACAATGTTGCCTATCCCAAAGTCA |
| TGAAGATTTCTCTTATGTTAACTTCTAAAAGTTGTATCATTTGTCTTTTATATTTATATCTACATAATG |
| CACCTGGAATTGAGTTATATGAATGCTGTGAATTTGGGAGGGGCGTGTTTCCTTTTTTTCCCACATGGAT |
| ATCCAATCAACTCAGCCACATTTACTGGGGGAAGACATCTTTTTTCTAATGCGCTGTAGTGTTAGGTTT |
| TTCAAAACTTAGGTGTCTGTATATGTGTGGGTCTGTTTATGAGTCTGTCTATTCTTTTCCACTGGTCTGT |
| TTCCTACACTTGTGCCAATGCCACACTGTCTTACTTATAGCTCTATAAGTCTTGGTATTGTTAAGGAAAA |
| ATATTTGTAACATTTGTTAAAAATGGCAGAGAAGACTTTATTCAAGGAGGGGAACATTGTGATAGGTAGA |
| GGGACTGCTGCAACGAGGTCTTGCTGTGGTGAGGAGAGAGATTGGGCTGGAGTCCAACTTCTACAAGGAC |
| AAGAGGGGATTTATAGTCAAGCAGCAGGGTGGGGTCAGTGGATGGAAGAGGAAACATCAGAGACAGGGGT |
| ATTCTTGCTAGACCAACTCAACAGAATTCTTGCTGAAGGCAGGCCAGGGTGATAAGATATCAAGAGTTAG |
| GGGTGAGGACAGATACCAAGGGTGGAGAATTTTCACTAAAACTAGTAGGATTCTTGCTTAAACTGGATTC |
| TATAAGACAGAAAAGGAAGCCCAAGGTCAGGGTCTAGTGGAAGAGAAGGCTCCGGGGAGCCCGACCTGAG |
| TTTGATCTAGGAGAGTCTTTGTCAATATCCTGTAGAAATATGACCTTCACCTCATTTTCTTTTCCTCAAGT |
| GTATCTGGACTGTATTTGGCCTTTTGGGCTTCCAGGTGACTTTTAGAGTAAGTTTATCAAGATCTACAAA |
| AATAGCTACTGAGATTTTGATTTGAATAGTATTTCTTCCTGATAATTTCTGAGTAAAATTCATTTTAAGG |
| AAGTAGGAGGGGCAGTGGCCTGATGAAAAGCAAAATGAAGAAAAGAATAAGGAAAGACACAGTTTTGCC |
| ATCACCAGCCAGTGTTTAGTGATCTTAAAATAGCTGCTTTTGTTTTTGAGCATCATTTGTTGGGTATGGA |
| GTTGCAGAAGTTGGGTTGAGGGACACTGGCTTCTAGAATCAAATATTGGCCTCCATAGAGTGTTTCTGTA |
| CAGTGAGTTGGGAGGATGGGCAGGGGCCACTGAGGACTGTGGCGTGTCCCCACGTTAGAGTGTATCTCAC |
| ACAGAGCCTGTCCTGAAAATATAGTTATTTTTAAAAAGTGTTTCCCCCTCCTTTTCATTGGCCATTTTCT |
| CTTTTACTACTCTTTACCTAGCAAAGGGTGGGCATGAGAAACCTGGTCAGTGGAAGAGAAAGCCATTTTG |
| CAACAGTGGTTATAGGGGTGGGAGAGTAAAATTTCCTGGTTCCTGGGGAAGCTAAGCCCATTGGTAGGAC |
| CAGACTTTTGTATGTGTGTTTCTTCCTTTAGTCATCTACTAAGGTTAATAAATACCTTAAAAAAAAAAAA |
| AAAAAAGGACATGATCTCCCTCTGTCACCCAGGCAAGTGATCCTCCTGCCTCAGCCTCCCAAGGCACTGG |
| GATTACAGTCATGAGACCCTGCACTGGCTCATTAACAATTTTTTTTATATAGAGACAGGGTCTCGCCA |
| GGCTGGTCTCAAATGCCTAACCTTGAGTGATTTTCCTTCCTTGGTCTCCCAAAGCATTGGGATTACAGAC |
| ATGAGCCGCCACACCCGGCCAAGAAGTGCCTTTTATGTCTCAGGCACTGTTCTTGGTGCTGGGGAACAAG |
| ATAGACAAAATCCTCACTCTCATAGAGCTTAATTCTAGTACTAGAGACAGTCGAGAAATTATTAAATAGA |
| AGATGTAATGTTGAGCTCTGATAAATTCTATAGGAAGAAAAAGGAGAGTCAGGGACAGAGGAAGGGAAGT |
| GACGAAGGAGCCCTGTGGATCTCTGAGAGAAGAGTCTCCCAGACAGGGGGCAGGTGGAGGGTCCAGGACA |
| AAGGCTGGGCATGCCAACAGGGGAGAAAGAGGTATTGCAGTGGGAGGGAGGGAAAGTGGCGGGAAATGAG |
| ATGGAGGAAAGCAGCCCTGGCCAGACCCAAAACCTCACTTCTTATGATAGATATTTAGTAACACCCTTTT |
| CACTCTTCAATGATGAAATTTGTAGAAAATATAACCTATCTACCCACATCATTACAAACCATCCATACAA |
| TGCCTTAACTGTAATAGAAAGGAAGTACAAAAGGGGAGAAATGTATCATGACTAAGAAGTATTTCATGA |
| CTACACTGGAAGACATAATGGTGTGGTCATATGTTTTGCACCCACTTGTAGGATCACTGCAAACGTGGCA |
| GCTATAAATCCAGATGGCTGCAGATGTGTTATATTGGCCACTCAAATGACATAATCCGTGTTGACTTTAG |
| TGATGTGATATTTCTGAAATGGTGAATACGTGTTAGTAAAGTTCTAAACAAAACAAAGTACATCATTCCC |
| TATTGAAATCCAGCATTTATGAAAATCATGGAGGAAACCCTTGTGTTGACAGGTAAAATGGCGTAGGCTT |
| TTCAGCCCTTCCAGGGGAGACTGGAAAGTCCTGGGGGACATGAAATATTTGTGGCTTGTGCTAGACCATC |
| CCATGTACTGCAGGTTGTCCAGCCTGTCTGGCCCCACCCCTTAAATGCCACTAATGACTCCCAATTGTCC |
| TGTGACTACCAGAACAGCCCCCATGGATTTCCAGATGCTTTTTCAAGCATTTTGGGTTTTGTTTGCATGT |
| AATGAGAAGCCAGCAGACAGTTTGGATCAGGGAAGTGAAGTGACCCAACCTAGGTTTTAAAGAGATCTGC |
| CATTCATAAAAATAATGAAGGGGAGGCTGAGGTTTCTGTGTCACTTAGCAAGGACTCGGCCCCCAAGAGT |
| GAGCTGCAGAGGTACCAGGCTGACCTCTGTCTGTCTCAAGCTTAGACTCACCCAGAAGTCTGTCTTTCTA |
| CCCCAGAGCCACCTAGACCATCCATCAGAGGCCTCCCTCTAATGAGGAGTAGGGTGGGGGCACCCCATGG |

| Sequences |
|---|
| TGTCCTTTGTGCCCTAAACCCTTTACAATAACAGGTGTTGGCTGTCACCTGAAGCAGGTTTCAACCATCA |
| CTCCCTTCCCACCATACACACACTCCCAGCTCATTTTGATTCCTTTTCCTGCAATAAATAACAGATTCTT |
| GCAAAGTGTTAGAAGAAATTAGTAAGTTAAGCCTCACACTAGGGTTATTTTGCCAGGAGACCTTCCTTT |
| CCTAGGTAACCCCCTCCACCACGTGGGCACCCCAGTGGGATCTGCTGCAGTCTGCGCCAGGGTTTGCTTG |
| GCCTGCAAGGGTTGGCCATGGCAGATGCCTTTCCTGTAACTGGAATCCCCCATGCCTGGCCTTCCAGACA |
| GTAGAGAGATAATTGGATAAACCCTAAACTGGAAATTACAAACAATAACTACTCTGTTAGTTTACATATG |
| AAACTACTTAAGCAAGTCCTTTTTATTTTTATTTTTCGACAATATGAAGCTCATTATTCGTGACACTCGG |
| GGCACTCTCAAAATGTGCTCAAGAAAAGGGTCACGGCTGTGTAGTATTTAGCACCAGAATGGAAACACCC |
| ATTCCAAGTTCTCTTCCATCCTTTGGCCACTGAGAGGTTTGGTTTAGTGGTCCCGGGGAGGACAGGAAGG |
| GGAGAGCCACTTTAACTTGCTGTTGTTGAGTGAAGGTGGGGCAGGAGTGAAAGGCATTGTTGTTGCTGAG |
| TGTGTTTTCATGAAATCTAACCTTATTTAACATGATCTCCAGTAACTCACTGGTCTTCAAGTTACATAAA |
| CCTTGATCGAAAATTATTTCCCTTTTTTTTTTTTGAGACAGGGTCTGACTCTGTCACCCAGGCTGGAG |
| TGGTGCAGTGGCGTGACTGGCTCCCTGCAGCCTCAAGCAATCCTCCTGCCTCAGCCTCCCAAGTACAGG |
| GATTACAGACATGAGCCACTGCACCTGGCCTTGATTTTTTTTATATAAAAGGATATTAGAGCAAAAGAG |
| TGAATATGTATACCATAGTGGTCAAATAAATACTTCTGCAGGGGCCACACACAAACTGTGAAGGCAGAA |
| TCTATTTCTGTCCTTAGATGTGTTGGTCAATAGGTGTTTGGGCCCGTGAATGTAGGACCCAAATGTAATA |
| GCAGCACTATACTCTACAGCGTGTGCATAGCTGGATTCAGAATTTTTGGTTTTAAAAATTAAGCTTTTAT |
| TTATATTTACCCATCAGGTCACCGAATACTTGGATTCAACCAAATGCTTGAAAGCTTCTTCATTTGGGGG |
| AAGGTGGGTTTGGAGGCAGAAATCCCTGCAGACTCCACACCCGGGGTTTTACTAGGTCCTCCGCGGCAGG |
| TGGAAGGCAAAGCTTGTTGCCCTGCAGTTCCGTTTGCTTCAAAAACAAGGGTGGGAAGGGTTCACCAATTG |
| ATCTTTGTGCATATCCAGTGTAGGAAAAGTGTTATTTAGAGTATCATTATAAAATCGGCTGCATATGTG |
| GCTCATGCCTGTAATCCCAGCACTTTGGGAGTCCAAGATGGGCAGATCACTTGAAGTCAGGAGTTTGAGA |
| CCAGCCTGGCCAACATGGTGAAACCCTGTCTCTACTAAAAATACAAAAATTACCCGGGCATGGTAGCGGG |
| CACCTGTAATCCCACTACTCGGGAGGCTGAGGCACAGGAGAATCACTTGAACCCAAGAGGAGGAGGTTG |
| CAGTGAGCCAAGATTGCACCACTACATTCCAGCCTGGGTGACAGAGCAAGACTCCATCTCAAAAAAAAAA |
| AAAAAAAAAAAAAGAGTATCTTTATAAAAGCTTGACTCCCATGGTAGATGGACCTAATTAAGGTTTACCA |
| GCAAGTCCCAGATATTAGCATAGCATAGGAAATTACCGTAGAGGCATGTAGGAGTCATCCAGATTTGGCC |
| AACTCAGAGGATAGAGAGAAAAATATCTCTCCCTCCTTCCTAATCTCAAGGGAGATGGAAAACAAGAAG |
| ATTTAGAGCTTCAAGAATGAGGATTGAGGAAGTACAATGTAAAAATGGCTCCCTGGGTCCCTTCTTGGAA |
| AAAAATGTCCAGAGAGTTTCCAAAAGTGGTTTTCCCCTCCTTTTTGAGGAATATGTGTTTTTATTCCTTT |
| GTGAAGAATATCATCTTAGTAGTCTTATTTCATTTGTCTATTTCCCTCTTTAATATTAATTTGATCTGAG |
| ATGCTTGTAAAGACCAAGCAACAAAAAGATGTCATGCCACCTTCATTTGCCACCATCACCTGTGAAGTTC |
| AGACAACGCAGTATAGACAGAGCCTTAAGAGGGAGGAGTCAGGCGTGAGGCTTTGTGAGGGGTGGGTGGT |
| CAGGGGTGTAGCCACAGCCTTTGATCATAAACCATGACCGGTTAGAACTGGGAGGAACCTCAAAGTCGCT |
| AGGTTCAACTCTCTCATTTCATAGACACGAAAATGAGGTCCAAAGAGTTCAAGAGACTGCCAAGGGTTG |
| TACAGCTAATCGGCCGACCTAGCAATCGAAGGACAGATTTGAGTATTTTTTTTAAAGCATAGGCTTTTA |
| AGTTCTTTATCATTGTCAGTTTACTTTGGTTTGCCTTTAACCTTCACCACCCCAGCTGGTAAGTGTAAAT |
| TGTCATTGTTAATGTGCTTTTTCCTTGAACTGCTTGTGAAGGACTCTCTTTCAAAGGAGCCGGTAGAAGG |
| GAGGAAAGTTGGTGGCATATTACATATCTCTACGCTGAGATTCAATCCAGAACGGCCTTGGGAGTTCTTC |
| GTCGGCTGACACAAGGCAAAGCCCCAGCTCTGATCTGAAAAGTTTGTATGATGCATTTTCCATGTGTATT |
| GGTTGATTGGTTTTGCTGGAAGACCTAACCAAGAGAAAGCATTCCGACCCTGGCGTTAGCCCCACTCATG |
| AGTCTACTTTATACTTTCTACATTTTGTCTATAAAATTTGCCACTTAAAAACTCTTGTTTCATAGAAAAT |
| GGACTTGATTATCTGTATCATTATGAAAATCCTGCTGCATTATCAAATCTTCCTAAAAGGTTAAAAAGCT |
| TTTTTTTTTTTTTTCAATCTCTGTCTTTGCTGTGATTTTAGACTGGGTTGTAAACAAGCTATAATGTGAAT |
| GGACTAGCAAGAGATCTACAACAGAAGCAGCCTCAGAAATAGAAATTGAATTTATAGGCAGTGAGATAGG |
| ATAATTAGCTTTTATATTTAAAAATATCCTCAGACCAGAGGAGTCTGCTGTCTCAGATAGAGAAGGGAAT |
| TGAGTTTGAATCCTAATGCCTCAAGTAATTTAGTAGAAACTGCCTGTTTTATATAAAATATATACGGCAG |
| CCTGCTGTGTGTGTATTTATGATCTGTATCTCTATATTCCTCTCTAAACACATGAGTTAAAGTGTCAGTC |
| TAAGTCTGAACATTCAGATTACACAAATCATTTGTACTTTATAATTCTCAGCCTTAAATGTTGTTGTTGAT |
| ATAGCTAAAGATAACCTGATTGGCCAATTATCTCCCTTTTTTCTTTGAGTGGTTATTTGGAGTTCAAAAA |
| TCAAACAAACAAAAAACATTTCTGTTTTTTTTACATGGAGAGCAAGAATTGTCTCGGATGTTTACCCGAA |
| GTTTTTTGTTTTTTATCCAACCATTATGCACTACAGAATGTACAATTTAAAATGCTCTATGTAGGTTAAA |
| CAATAAAAGACACGAGAATATTAAGTGTCTGCTATTGTTAAATATGTGTAAATTCAACATACCTCCTGTA |
| ATGGCCAGTGTCTTAGCCGCTGATCCCTGTCACTCTGAATTGGCAGAAACCAGATCCTGGCTTGGGATCT |
| TGAACAGATATTTTTTCCAGGGTTGCATCACAACTCTTGGGAGGGCATCCTGTCTGAAATATGCTGTCTC |
| CCCAGCCTGGGTCAGCAGGGACAGAGAGAAATAGCATCTGTCAGCTGGGTTGAAGTCTCCCGCATATGGA |
| GTCAGTCACTGGTTCTTTGCTGAGGGTTCAGCTAATGAGACTTGATTGCTTGTTGGCACTCTTGTTTCCAC |
| CAAAAAGAGCCTAAAAACAGGATGAACTTGAAAACAAGAGGAAGTGGTGCTATGCTTCCCCATGACTTTA |
| GCTCCAGTTTGCCTTTGAGCAAGGGGGAAGCAGAAGGAGGAACTTCTTACGTACCTGCACGGTGGTTCAT |
| ACCAGGGGTTCATCAACCCTGGGATCTTGCCCCCTTCTCTGCCTCCTGTCATAAATCTCTGTTTCAAAGG |
| AAAGAAAGGGGATGGTTGTTAAAGCATAAACCTCCAGGTCAGCTCTTGTTACATTAGACCCCAAGATGAT |
| GTCCAAAACCTTTTGTTGAACTGAAATGCTAGCTTGGTTTGAAATAACTGAGCCATTCATTGCCTAGGGA |
| TAGAAAATCTTTCTGTTGTAAAGAGGTGGTTGGTTGGTGTGTGGCTTTGTTTGCAAATACAGAAAG |
| TGGGATGGGGATTGGAATAGTATTGGCCTTGTGGGGCTGAATATTGAAAGCAGCAAAACTGGATGTACC |
| TAAAAACTAAAGTTGAATCGGCGAGTTCATCCATCCTTTTAGAGCTATTTTCATTGAGATATAATTTCTT |
| TCAGTTGCTTGAAGTTTTCAGCATCAGATCAAGTTTTCTTTCTTGCTCTCCAATACCTCTTTTGCTTGTT |
| TGCCATCTGTTCATTTCCACTGCAAACTGCTCTTTACACAATGTTACTCGGTGTTAATTAGAACACGTGT |
| CTCTTTGTCATTCATCTGGAGAAGGGGTTAATGATGATTTATGTCCCTTTAATTGGTTTTCCTCCAAACT |
| GTTAGGTTTAATTTATTATTTTATAAGAATTCCAAGAGACTGGGAAAGAGGAAGAGTGCCTAATTTTTAT |
| TCTTCATGTCTTTAACTATATATCTCTTTTGCTTTAAAAAAGAGCAATCTTGGCCTAACTATTTTGGTGT |
| TTTAAAAGTATGGTTCTTTGGCCAGGCGCAGTGGCTCATGCTTGTAATCTCGGAAGGCCGAG |
| GTGGGTGGATCACTTGAGGCCAGGAGTTCGAGACCATTCTGGCCAACATGGTGAAACCCCATCTCTACTA |
| TAAAACACAAAAATTAGCCAGGTGTGGTGGCACATGCCTGTAGTTCCAGCTACTCAGGAGGCTGAGGCA |
| CAAGAATTGCTTGAACTCTTGAGAGGCGGAGGTCAAAATGAGCTGAGATCGCACCACCGTACTCCAGCCT |
| GGGCGACAGAGCCAGACTGTCTCAAAAAAAAAAAATTCTTCAAGTTCTTATTAAATGATAATACATATGA |
| GTATGTATTTACTGCTTATCAGTGAACAATTTATTAGTCAAATTTGTTAGCTTATTTCTGAATAAGTAAC |
| ATGTTATCATGGTTCAAAATTGAAAAGGTCCCAAAAGGTATGCAGTGATTTCTTTCCTCCTCCTCCTATT |

| Sequences |
|---|
| GTCCCCAGACTTCTATTCTGGGAAAAGGGTTTCCTTTCCGCAGAATCTATGTTGTCAGGGTCTTGTGTGT |
| ACATATATTTGTATTTATGTATACACATATGTGTATAGATGGATATATGCATAGGTACATATATATGTAA |
| ATACTTTCCCTCTTTTTATGCAGAGGGTGGCAAACATATATGCTGTTCTGCATATACCTTTTAAATGCAT |
| TTTGGAATGTACTGCCTATCGGTAGGTTAAGAGCTTCTTCTTTCTTTGTTAAGGCTACATTATACTACTG |
| TATGATGACTTATTAACTACTTCCTGACTGATAGACATTTGGGCTGTTTCCAGTTTTTCCCAGGATGAAC |
| AGTGATTCAGTGAATAGCTCTGTATCACATTATTTTGTATATCTCTAGGAAAAAGATCCTAGAAATGGAA |
| TTGTTGCAGCTGAAAGTAAGTACATTTATCATTTCGATTGATTTTTGTCAAATTGCCCTCCATAGACGTTA |
| ACAGTTAACAATTCTGCTAGCAATATGAATACTCGTCAGCTTTTTTCATACTTGTGAAAATAGTAGGTGA |
| AATAATGATCCCAGCTTATGGTTTAATTTGCCCTTTCACTTATTTTGAGTGATGTTGAGTATAATGAGCA |
| CTTTAAAGGAAAAAGATAAATTTTTGTAGTTAGATGTATATATATACATTTCAAAGGTGGAAACCTGTT |
| TGTGCATTTTCCTTTCTACCCCCTCAAAACACTAGGAAATTATACCTAGTTTCTAGTAAATTAGATAGCT |
| AATTTCTATATTGGTGTGTTATTAACAGTAAATATGCTGCAAATGTTGGAAGATACCTAACATTCTCCTT |
| CATGTGATTACCAAAAACATATTGCTGAAATCCAATTTCGACTGACATTATTTTCAAAATAATACATTT |
| CAAACTAATCAAATCAAGTTTTGATTTGTAAGGGCACATTACATGATATCTTTAAGATACAATATTTTA |
| AGTCAATTAAACTCTGATGTATGTTGCTTTTTACCAAAAGCACACAGATTATGGAGAACTCACCAAGTGA |
| CTGACATGATAAAAAAGCAAAGTTCTTTTAGATAAAAATGGCCACTTTCTCCTTGATATTTTTCTATGGG |
| TTGAGATTTAGATGAAAATCCCTTGTGGCAAATTTTAATGACTATTTCTTTAATGTAATAACTGAATTCA |
| TCTAGATGATCCCACGTCCCTCAACAGAGAAAGGTGAGAGTCTGTTATTTGTTAGGTTTCCTTGTCCATA |
| TTTCTTGGTGGGTCCCACAAAAGTCTCATGAATCTCTACAAGTGGGAAAATAAATTGCCCATTTCTTGGC |
| ACACCGAACTTTCCATGTCATATTTTAAAACTGTAAGTCCATACTTTACATAGCTAAAGACCAATGGGCC |
| AAAGCATGGTGGGTCACACCTATAATCTCAGCATTTTGGGAGGCCGATGTGGTAGGATTAATTGAGCCCA |
| GGAGTTTGAGACCAGCCTGGGCAGCATAGTGAGACCCCATCTCTATAGAATTTTTTAAAAAATTACCGAT |
| CATGGTGGTGTGTATGCACCTATAGTCCTAGCTACTTGGGAGGCTGACTCAGGAAGACCATTTGAGCCCA |
| GGAATTTGAGGCTGCAGTGAGCTATGATGACACCACTGCACTCCAGCCTGGGCAACAGAGAAAGACTCTG |
| TATTTAAAAAAAAATGGAAAAAGAAAAAAAGACCGAATAATAATAATAATATGTAATATTTAATACTTT |
| CATGGATTGGGTACTGTTTTCCCTCCCCTGTGAGTCCCTGCCTATGTTTCCTTCAGGCCATAAAAAGAAA |
| GCTTGTCTGGCAAATATGAAATTTGAAAACTGACCATCTGCTGAATTATAATAGTAGAGATTTACCTTTG |
| GGATAAATATATTTGTCATTGCCACAAAGTTTGTGAATAATATTTCTGTTGCCCAGTCATGAAATCAACA |
| AACCTCCAAAATGAAGTTGCTTTAAGTGTGTAATGGCAATTTTGAATTGTTAAAGTATTCCACACTGTCG |
| TGAAACCAATGTAAACCCTTGCTCAGAACTAGACTCACAAAATTTTAGAGCCAGAAGGAGGTTTGGAGAT |
| GGTCCAGCAGTTCGTCTCAATTTTATAAGTGAAAAAAACTGAAGCTGGGCAAGGTTAGGAACATGTTAG |
| CAAGTGAGTGAATGAGTGAGTTACAAAGCTGGCATCCTTGAATCTTGGCCCCAGACCTCACCTGGCTAAA |
| TTGTTCCAGAAATCTTGCCTAAACACACTTTTTTTGTAGTGGAAGAATGTATGCCCTTTTAGAAATCAGT |
| TCTAAGGTCTCTTAGTAAAACCATGTGGTAGGTCATCCTTAACTGGGGGTTGGTTTTGCTGAAGACAGTG |
| AGCACAAGAGAAACCACAGAATGCTCTTTCTAAGAAACATCTAGACAGCACTCATGAGGCATACACTTG |
| GTGTTCCCTCCCTCTCTTTTTCATTGGTAGGCTGTAAATTACTCCCCTGTTGGAAAAATAAGGTCTTCAG |
| GCTACTCACGGTGGTGTGCAGACGCACATATACACAACAGTGACAGCTTTCTAGTGGCTTCCGCCATGCGTG |
| AAAAGAGATGCAAAAGGAATGCAGGAATGTTAGAGAAATAAAGGCATCGCCGCTGATTAGCTGGGACTG |
| ATCAGAGATGGGTTACTTCACGTGAAGCATGTAAGGAAACCTCTTGTAAAGACTTTTATTATATTTTTAG |
| GAAGGAAGGAAGAAAGACAGAAGAGAAAAACAGAGAAGGAAAGGGAGAAGGGAGAGAGGGAGGAA |
| GAGAAAGACAGAGGGAAGGAGGGAGAGAGCAGGGATTTACCTGCATTACAGGTAGCATACCTTCTCCAAA |
| GTCTCCTTTGTGGACCAGAGGGACCATTGGTGGCAGCTCCCTTAACCACAGTCCAGAACTTTCAGTATTA |
| AAAACTTAGCTGATACCTCTCAAGGATATATATTTACTGCAGGTCCTTCATCTGAAATTCAGACACATGT |
| AGCTAGCTACAGATCACCTATAAGATGTTTCAACCTCAACAAATTTGGGACTTAACCCATCATCTTACTC |
| CCTCCGCCACTTCCTTTGCTTGATCTTCTTATCTCAGTGAGTTGCATCACAGTCCTCCAAACTGATGAGG |
| TCAAAACTCTGGTAATTATCCTCAATTCTTTCTTCTGTCCCACCTCTAGCCACCATCTAGGTCAAACAGC |
| CCAGCTGACTGCACCTCCTTTGTGTCTTCCCCACTCCATCCCTGCCTGCTGCCACTGCCTTAGTTCACA |
| GCCTCATCATTTCCTCCTTGAGTTGCTGCAACAATCTCCAGCTGGCCTCTCTGCCACCCAGTTTTTGCCT |
| CTCTCCAACCTGTCCTCCTGACTCTTGCCAGAGAAATTTTTCTAGGAAAACCTACCCAAGCACGGAATGC |
| CCCTGTATAAATGCTCCATGGGTTGCTGAGCACCCCCAGAGAAACTGTCGTGACTGATCCACGCTCTCAC |
| TTCCTCGGCCTTGCATCGTGCTGTCCCTGCCCTCCCAGGCTCTGTGCCAGTCACCCAGGCTTCCCTCAG |
| TGCGAGCATCTCCTCACCTCCTGACCTTTGCACAAGCCACTCCTTCTGAGGAGCACTCTCTGTTTCCCCT |
| GCTTCTCCTCCTTGCCTAACTCCTACTGAGCTTTCTAATCTGACTTTGAGGGCACTTTTCAGAGATGT |
| CTTCCTTGACCAACCGAGTAGACTTATTTAACAAACACTTGCATAAATTTACTGTGTGCCAGGCACTGAC |
| CTAAAGGCTTTACATATATTCCTTCCTTTACTTCTCAAACTTTAGGAGAAAGGGAGGATTCCAGTCCCC |
| ATTTTATGGATGAGGAAGCTGAGACCTTGCTTGAGTGGTGAAGCAGCTTGCCCAAGGTCACACAGCCTTG |
| TGGGCCAGAAGCTACTTCTGCCTTTGTGTGGCTCCTGATTTTGATTTGTATGTAGTATAAAATATATAT |
| TTTTGTGTGTGTGTGTGTGAGAGAGAGAGAGAGAGAGAGAGAGAGAGAGAGATTTATGTTCCAAAT |
| TGGTTCCGGGTTTGTCATCTGTATATTTAATATATAATAAATTATATATACAATTTATTTTTTGAATAGA |
| CAATAGAAGCACATATTATAAAATTCAAAAAATACAAAGTGTATACAGTGACAGGAGCCTCCCTCCTCAC |
| TTTACCTCCCACTTCTCCCCAAAAGCAGCTCCTGTCACCCATGCCCTGTATCTTTCCAGGGATATTTA |
| CAAATATATATGTAGACACTATGTGATTTTCTTTTATATTTATGATAGCCTATTCTGCTTGAGATTTTA |
| ATTTGCTTTGTTTGATTAACAGTATACCTTGGGGCTTGTTCCATATCAATATATTAAGAGCTTCCTCTTC |
| TCTTCTGTGTCTACATAATAGCCCATTGTAGGGATATACCATAGTTTATTTAATCAGTCTCCTTTTTGGA |
| TATTTAGGTTGTTCTCAAACATTTTCTAGTACAATCAGTGCCGCAGAGATTAGCTTCCTACAGACATCAT |
| TTTGCACACATACGAGTTGATCTGCAGGATAAAATCCTGGAATTGGAATTTGCGGCCAAAGGGCAGGTGC |
| ATTTATAATTTTGATAGATAGTGCCAGATTGTCCCTCATAACGGATGTACTCATTTATTTTCTCATTAGT |
| AGTTTATGAGATTGCCCCTTCCTTCTTAGCCTCACCCTTGCCTATATAATAAAATGTTTTGATGTTCACC |
| CTTCTAGTATTTTAACCAGCTTTTTTCTTGTTATGAGTCGTTATGCATCTTTTAATGTGTTTATGAACT |
| ATCTTGATTTTCTTTATTAGCTGATTTAGTATTCGTTGGCTCTTTTCATATTGATTTATAGGCATTTCCT |
| ATATATTAAAGAAATATATCCTTTGTCTGTGATCTATGTTCCAGAGTAGGTCCCTGGTTTGTCATTTGTTG |
| ATGGTGTTTTTCCCCATGCAGAAAATTTTTATTTTCATGAAATCAGATTTTATCAGTTTTTTTCTTTTA |
| TAGCCTCTGGGGTTTGAGTCATAGTTAAGACTGACCTTCCCCACGCCTAAATTATAAAATCCTCTTCTAT |
| GTGCATGCATGGGTGTGTGAGGTTGTTTCAAAGAAAGAAGTGATAGAGTGTAATCGCTGAGAAACCAAC |
| TGTGGAGTCAGACTGACCTAACTGCCCTGGTTTCATCTCTATTTCTTTAATCTTGGATGAAATGTTTAAT |
| GGGTTAGTAATATCTATATCCCAGGGTTACAGGTGACTATGAAGATCACATACCACAATATAGGAAATCG |
| TCCTGTATTAAATTACTGATAGCTGTTTTTATTGTGTTATTTTCTCCAAGTTTAATAATAATTGCACAAG |

-continued

| Sequences |
|---|
| AACAAGGGCCCTTTCTTCTCTTTCTTTTGCTTTCCCCTTGCCATTGTGGCCCTTCCCCTTCCCAAACTCT |
| GCTGCCAGCAAGACCTTAGCGTGGTGCTCTGCTGATGGGACTCGAGTGCTCACTTTGATTGCTTCACTGT |
| TTATTTTGATTGGCGACAGAGAGGCCTGGAGTTCTGGCTGGCAACCTGGAGTGCCACAGGTGCTTCTC |
| CACTTGCCACGCAGCTGTTCTCCCAGTCCCTTGAGGACCCTGGCGCCTCTCCAGATCTTGGCACTTGGTT |
| TCTTTCCATGGGTCACCGGTGAGAGTCCGTGTTCTTTCCTTTGGGCCCCTGCAGCCCCTTGCCACAGAG |
| GCCTCATCCCGAGAGGACTTGAGACAGCGTACTCCCCACATGGGTGCCCTGTAAATATCTTTGACCAAAG |
| AAGTTAGGAGAAGTAAGAGGTTTGGGGTGTCATATTGACTGGAAGAGCCACAAATCTCTTGGCTATCTCT |
| TCGTTCCCATTGATTACACAGGAAGGAATTATTCCAAATCATGTATTTCTTTAGTGGATGATCCCCTTAA |
| AAATTTCTACGATGTCAGTTTCTGTTAATATTTACTACAGTTTTATTGTCATGGATTGTAACTTCTTAA |
| AAATATTTAATATCATGCAAGCTGTTCAAAGACACCAGTAATTTGGAGACAGTGCAGGGAATCGGGCTGT |
| GATTTCCTGGCTTTTATCTGTCTCTGCTGCTCCCTTCTCCTCTCCTTTGCCTGTTTGTGTTTCCTTTGTA |
| CACTCACTTTTAACAAAGGCCCCTTGAAATTCCAGGGGTAGGAGACACAGTGGAGCATTGAGGTAGGTCA |
| TCTCATATTTAATTTTGCCACTCTCTGGCCGTTAATTAAATAATGCTTGAGTGCTAGTGTCCAGTTTTA |
| CAGGGGGTGTGTAAAATGTTAATCACAACTGATCTGAAGCATCCAGTCCAGTGCCAGGGAGAGGGTTTAG |
| GGCACAGGCAGGGAGCATGTTATCAGGAAAAAATAAACTAGAGGAAATAAAACATTTTGTTGTTCTTTA |
| AAAAATTTTAATATGAGGCCCTACTATGAGCAAATATGAAGGAGGATGTGAAGACGGGTAAGGTGCAGTC |
| CGCGGATTCAAAGGCGGGGCCATCTGCATGCTGAGCGTTTTACTATACTATTCCATTTAAGATTCGCAGC |
| AGGCTGGGCGTGGTGGCTGACGCCTGTAATCCCAGCACATTGGGAGGCCAAGGCAGGTGGATCACCTGAG |
| GTCAGACGTTCGTGACCAGCCTGGCCAACATGGTGAAACCCGGTCTCTGCTAAAAATACAAAAATGAGAT |
| TCGCTTAAACCCGGGAAGCAGAGGTTGCAGTAAGCTGAGATTGCACTATTGCACTCCAGCCTGGGTGATG |
| AGAGTGAAACTCCGTCTAAAAAAAAAATTTGCAGCAGTCCAGAAGGTAGGCCCCATTATTCCGATTGTAT |
| GGGTGAGGATACTGAGTTGAAGAGGAGTAACTTGACATTGATCCCATTGTACAGTGGAGCCAAGATTAGA |
| TCCAGGGGACCTGGTTTCCCAGCCCCATCACCTCAGTCCTATTGCATTACCCTCTGGAAATGCTCAGTCC |
| AGTAAAGGAGAGTGATGATGCAATGATGTGACTGCTTCCAGTGAAGTAAAATTACACTGGACTGCCTGAAACT |
| CGGGAGAAACAGATTGACACCCTTGAGTTGTCTTTCTGGTTAGGGCTTTTGGGTTTTTGTTCTGTAATAC |
| AGTCCAATGTGGTGGCCATTCAAGGGAGAAGGGCCACTCATCAGCCCTCCTGCTCCCTCACCCCCATCTT |
| AATTAAATAAGTCTCCTTAGGATCTGACACACCTGCATGTAACAAAACAGGTTTTAAAAATCTGTAGTCA |
| AGGAGCACTGCTTGTTTCTTTCTGGCAACAATCCCAGTGAGGTAAAATTACACTGGACTGCCTGAAACT |
| CTGAGCCCAAAGCGTTAATTTTTGAAAAACGTTTGAGGTTCCTGAGTTCCCGTGGTATGCTACTAGAATA |
| TTCTGTAGCTTTAACAACTCCCAGCCTTCATTCTGCACTGCACCCCCGCACACCCAATACCTATTCCAC |
| ATGTCTGGGGATAGGTCAGCTCACCGTCCACCCTCGCTGCCCCCTAGGCTGAGGTTCCCTGATGAGCACA |
| GTTTTCCGGGAAGGATTTCAGCCCCTCTGTGAAAGTCTTCAGTTATCTCCTCTCTTGTTTCCAGAAGTAG |
| CTTCTTTACTCCAACTTGAAATCTTGCTGTATTCCTTAGTGTTTTGGAAACAAAATGTGCAGTAGGAGAA |
| TTCTGGCTTTGTGGATATTGGATCACTTTGTTCCCTGGCACAACAATCTCTCCTTTGTATTAAACATCTG |
| AGAACAGAAGTCCTAAATAACATTTTTATATTCCTTGTTGATGTAAGTTCTTTATTTGGGGACAGCAGTT |
| TGGTACTTGTTCCTCTGTCAAATTCTGATGTACTTTCCCTTTTTCCTATGATGAGGACACCACTGACCCC |
| TAGCCTGGAATTTTACTTTGGGTAGTGGTGGTATTTGCTTACCCCGTGGGACTTTCCTGTTGAATCCCTC |
| TAGTCTGCAGTGAGTGGCCTGTGTCATAGTGGGATGTCTGACTGGTCGGAGCAAAGGTACCCAATCCTCC |
| AGCCTGACCATGAGCTGGGTGGTGAACTAGCCAGCCACAAACAAGCCAGATGGACAGACAGACCAAAATA |
| GCCACTTGTCCACCTCCTTCCTGGAAATGCAGAAGGGCTGCTCCGGAGGTCCAAGAAGACCTAATTTGGT |
| CAGCAACCCAGCACTTACTCTGAACAGGAGGTGGAGTTGTGAGCCTGGTATAAGTTCCCTACCTCCGATT |
| CTTTACTTTTACCACACACGTTTGCACATTTCAAGGAGATGATCAGCCACACTACCAACTACTGATGGGT |
| AACAAATACTCTTTACGTCAAAGCTCTTCTGATGATTTTCCTGGATTCTGTACTTGTACAATGAATGTAC |
| TTGTGCCTTTACTCCAAAGAAAATTAGTATATGTGGCTGGGCACAGTGACTCACGCCTGTAATCCCAGCA |
| CTGTGGGAGGCCGAGGCAGGTGGATCACTTGAAGCCAGGAGTTCAAGACCAGCCTGGACAACATGGTGAA |
| ACCCCACCTATACTAAAAATATAAAAAAATTGGCTGGGCGCAGTGGCTCATGCCTGTAATCCCAGCACTT |
| TGGGAGGCCGAGGCGGGCAGATCACTTGAGGTCAGGAGTTCGAGACCAGCCTGGCCAACATGGGGAAACA |
| TTGTCTCTACTAAAAATACAAACATTAACTGGGCATGGTGGCAGGAGCCTCTGGTCCCAGCTACTTGGGA |
| AGCTGAGACAAGAGAATTGCTTGAACCTGGGAGGTAGAGGTTGCAGTGACCTGGGATCATGCCACTGCAC |
| TCCAGAGCGAGATTCTGTCTCAAAATAAAAAAAAAAAAGAAAAAATAACAACAAAAAGAAAATTAGTA |
| TATGTGCTTTACTCTTTAGGCAAACCCAATATTATACAAATTCAGTTTTTAAGACAGGATAGGACATTT |
| TATTTTTCAGAAAATGTATAACCACATTCCTTAAATGGCGTAGGTAGTATAATATAAATATGGTTTATCC |
| CCTAAGACCGTTTTTATTTCTATGTGAGTTTCAAAGCTCTCCCTTTTTCCTATTCATTCAACAACTCCAC |
| GCTGAGTTGTCTTATGGGAGGAAAGGCTGCCCTGCATGGCTCTCTTGCAGCTAATGAAATGAGCAGTTGG |
| CTTTGGTGTTTTATCACTTTGGGTCAGAGATCTATTTCTTGCTCCTTACTCCTTCAGTGAATATCTAGTT |
| CGTGCTCCCTATGGATCAAGCATCGTGCTGGTCTTCTTCCATCTGCCTTGTTCCCAGTGGGAGCAGTTGG |
| AAGGATGCTGATGGTTTCTTCCTCCAGGAGAGGAAGGGCAGTTTCATGTCACTCACAACCAAGCAGCT |
| AGTTGTCGGCTCTTGGAAAACTAGTTCACCAAAGGGAAGCACTGAGCCTGAGGCCCTGGGATGGGTTGGA |
| TTCTTTTCTAAGTGGAATAACATTCTACTCCTCCTGCTTAACCTTTCCTTGCAAACTAAATGGGAAAT |
| CACTCTATGGACAAAGTCAAGCAGAAATAAAAAATACCCTCTCTGAGGCAGCCTGGCAGTACCTGCATGA |
| ATCAGCCAGTGTTTGGATAAGAAGCAGCCCCTCGAGAAGGAATGAGCCCTTCCCTGGACCTTAATTGAT |
| TTTTGTATTTGTTCTTCTTCTTTTAATTCTTTTGTGGAAAAGTGATTTGTACTGCAGAGTGGCTTTAACAT |
| ATTATGGGTGCTGTTTTATGTAATACTGTTCTTATCTAAAGATCATTTCTGCTTGTTTTGCCCTATTTTT |
| TTTCCTGATCCAGCTCATGTTTGTTTTCTTTTTCATTTTATTTCTTCTTTTTGAAGGAGTTATTGTTCC |
| TCTTATTTCTCCCACTTCATCTACCCCCGTTATCTGCCAGGAGAATAGGAGAAGACATGGGCCACTTTTT |
| TTTTTCCATTTTTAAAATCAATTGGCTAGATATCACCTTTCTCTGGAGTTTGTTTCATAACGCAGAGC |
| CTCATTAGTAACGAACCTGACCCTTAAGAAGTTGGGTATGTTTATTCCTAGGGATTAAGGCACTGTTCT |
| GGCCTGGTTGGCCCTTTGCTGTCTGTGCTATCGTCCGCCCCTGCTGACCAGGCGTGCCTGGCTCATGGA |
| CAGGGCAGCTCCTTGCAGAGGTACCCTGCTGTCAGGGAAAGTTCTATGGACTAGTAACTGCTAAGATCTT |
| TTTTGATAAAATGAGATCTTGAAGCCTTCAATCATGAGCCTCAAACAATTTACATAATAAATCCAGAACT |
| TGGAGATCCAAAAGATATTGCCATGTTTTTGGTTATGTTGCTAGGGAACTATGCCTCCGTTTTCAAATGA |
| TACATTGCTGTGTGTGTGCGTGTACATGTGCATGCATGTGTGTGTATGTATGGAATGAGGAAAATTAGGT |
| GTTTCATGCTTATGCATTGTAGTGAAGGCTACAGTGTTGTTAGGCTTTTCTGATGGATATCATAACTCAA |
| ACTACAGAATTTGTTTACAGCAGTGTTCATGTGACCAAGAAAAAAAAAAGCAGATGAAAGTAGCCAGAC |
| GTGTTCAAAACACAACTAATAGATCAGGTTTCTGGAACATCTGAGTCTAAGGGTTTGGTCTTCCTCACAA |
| TATGTTGAGAGGTGATGTTTTAAAAGCAAAAACGGAGAAAAGGCGAGCTGTGGAATGGTAACTGAGAC |
| AATTAGAAAGCAGATGTGTGCAATTGAATGTAGTCAGCCTTAAATGGATCCACACTCTCTTCTGTATGAG |

-continued

| Sequences |
|---|
| GGTCTGGAAGGGAGAGTTCACAGAATAAAAATGGAGTCATTTTATTCTTTCTGTTCAATATAGATTCCCA |
| CATACAGCGAGTATTTGAATTGTGACTTGCTTTCTCATTGGCGTAATTCCCACCTGCCTTTGGAAGTCCA |
| TTCCGAGGTGACCTTGCCCCCTGCAATATGGAATGGGAAAACACCTGGCTGAGTCTAGACGTCTGATAAC |
| CACGTAGGTGGGTAAGGTAACCACTGGGATGGCTGGAAGGTGTTACCCAGGGAAACTGAAGGCCAGGATG |
| AAAATAAAAGCAAACGGTTTCCCCTTGGGCAATGACTGCCATCAGGATTCTGCTGCTGATAAAATGCTGC |
| TCCTTTGTTCTGCTTCCTGCGTGTTCATCCATATGATAGCTGTTAGACATTTCATTCAGCTTTCACCCAC |
| CTGGCACTGCTTCAGTGCCAACCAACGGCAAGGTGCTCCCCAGCTGCCATGGGGAGCCGGGTACAAATAG |
| ACCTCAGCGAAGCCCTGCGTGCATGCAAACTGCGTTTGCCTTTTGCATTCTGCTTTTCTCTCGGGGCCAT |
| GCTTGGGACACTTACACGCTGCCCGCTTTCTTTCTGTGATGGGGGCTGGTGCCTTTGCACTAGGCCCCCA |
| CAGTCATCAATAGCCCTGTTCATGTGGGAGGTGACAGCAACATTTTGCCACATTACAGGCTGCAGGGCTC |
| AATGTGAACATTCTTCTTAGAGTGAGCAAAGGGCATGGGACTTCTGACGGCCAGGGAAGTCACAGCCTGC |
| ACCACAGTGCGAAGATCCTCCATCTGGGCCATGGGGAGCACTTAGAATGTCTTTTTATGGGTTCAATAAA |
| ATGTGATGAACAAATGTTTGTGGTGAAGCTCTATTGTGAGGTTTTCTGATCATATGTAACATAATTACTG |
| AAATCTTTGTCAGGCATTGTTTTGCATTTTTATCTACAAAGGAAGCCAGTGACAAGCTCACCACTGTTCT |
| CTGTTTTCCCTTTAGTCGGTTCTTAATCATCCAAGTCAATAGAGAAAATCACCATCATCGATGACGCAAA |
| CCCGTAAAAAGTCCAAAAATAATTTGTGTTTGATTTTGAGATGGAGATGGTAGGCATGTGAACAAAACGT |
| GCCAAGACATTTAGGCTACTTTGAGGTCCAGGCCAATGCCCTCCCAACTCGGCTCTGCTCCCCCTGAAGC |
| CGGAGACCGTGTATAGGGATCTGGGGGACCGGAGGGCAACGCCAGAGAACAAGTGGAGGAGGTGGCTATC |
| AATCCTCAGAGTTTGTCATCCACTATGAAGAAAGCTGGCCAGGTTTTGTTCTGATAACATCACATAGATA |
| TTTTATACTTTTTAAAAGATGATCAGAGTGACATCTGTGTGGTTAAAAAGCCAAATAACACAGAAGGCTT |
| TTAATAAAAAATAACAGCCCTGCCTGGGTCCTGTCCTTCCTTGGTCCCACTTTCCAGAGGAAACACCTTT |
| GAACCCTCCCAGCTTTGTTGAAAGTTCTTTGGGTGGCTACCTTCATATCTTTAAATAATATATGGTAGTA |
| CCATTTGTACTAGTTTTCTAGGGCTGCTGTGACAAAATACCGTAAACTGGGTGGCTTAAAACAATAGAAA |
| TTTATTATCTCATAGTTCTGAGGGCTGGAAGTCTGTAATCAAGGTGCCAGCATGGCCACACTTGTTCTGA |
| AGGCTCAGGGGGATCCACCCCCCACCTCTTCCAGCTCCTGGAAGTGCCATCGGTCCTTAGCTTGCCCTCT |
| GTGTCCCTGTGTGTCCCTCCTCACATGGCATTTTCCTCTGCCTATAAGGACGCAGTCCTATTGGGTTAGA |
| GCCCACCCTAACGACCTCCTCTTAACTTGATTACATTTACAAAGACCGTGTTTCCAAATTAAGTCACATT |
| TACAGGTACTGGGGACTTGAACATATCTTTTGAGGGGACATAATTCGACCCATAACACTACTCTTTCTCA |
| GTTTATTGCCTTCCTTTTATAGTCAATGGGGTTTCTCTCCCTGATTCAGCCTCGTCTGTGTCTTCTCTCA |
| GACCTCTTCCCTCTCCATGCTCCGTCCCTCCACTTAAAGGACATTGCTTATTTCTCAAACAAATTCTTGG |
| AAACCTCATTTCTCATTCTGTTGACCTTAGAGAGCATCACTTAATTACTCATTTAAAAAATGAAAGCATT |
| CACTCTTTCGGCTCCCATCTTCTACCTCTGAGCCTCTGTCAGCTAGGGCCAAGCTTGATGCCATCCGTGT |
| TCTTTTCAGTTCCCTGAATGGTTAAATCCTCTGTCATTTGTCCTCAGACGAAGAATGGATATTTGTCTAC |
| AGCTTCTATTGATAGGATCTGAAAGTTGAAAACCAATAAACAGTGTTATCGTGACTCTGTCCTGGATT |
| ATTATACCTTTGCATGCCCTCTGGGTTTTAATTAAAATACTTTATACCATTTGAAAAATGACAGCATAAT |
| TTCTGTTTGTTTAGTACTTTAGAATCTACATTTATTTGATTTTAGATGGCAGCATACTTTGCTTGCTCTG |
| AATTGGGAAACTGTCTATTCGTTTTTCTTGATGTCCTTTGGCATTACATATTGAAATGAGGCTTTGTGTC |
| TTATAAATGTTTGATCACATGACACAGTAGCCGCATGGGTCTCTCTGTGAGTTTTTAGCAACAGGTAAGC |
| CATTCTAAGGTAGTGCTAGCCAAACTTTGGATTTCAATGCTTTTCATTTCTTTTTTTTAAAGACCAATAC |
| AGAGATGCTAACTTTTTATTTTGCCAGAATGGGATATTAATAAATCAGCTATTATTTACTCTCACTGGTA |
| AAATAAGAACATTTAACATGAAAAACAAAATAGTAAGGACATAACCTTGGAATAAGTTACACAATTTTAA |
| AAATTTTGAATGAATTTAACTTTCAAAGAACTCATTACTTTCCCTCATTTTTCCCATTTGGCATAGACTG |
| GTGAAAACATTCTGAATGGAATGGTTGTCCTAGATCAACCTTGTTTAGTGGCCATGTGTCTGGTTTTAAT |
| AGAGTAGAACATACTGTTAATGACTCTGCTTACTCTGTAGATGGTTAGGTTGATTGATTAGGACCTGGTA |
| TGGAAGATGTGCAGGAGAAGGGGGCAGGCTTTGTGTGAAGTGGGAGAGTTGGATCGCCCTATTTTGTGAC |
| CCTAAACTGTAAGTAGAACCCCATACCCCTTGCCACATGCCCCTAGTCTAAGCCATTTGTAAGCTGAGCT |
| AGCTCACAAATTCTTGCCCAACATGTGCTGTGTTGGGCATGAATTTAAGTAGATACATACAGATCTGTCA |
| CCTTTATATATGTAGCCCTTGAGTAAGTCACGCTTTCACTGTCTTAATTTATTACCATAAAGTTGGCCGG |
| GCATGGTGGCTCACGCCTGTAATCCCAGCACTTTGGGAGGCCAAGGCGGGCAGATCACTTCGAGGTCGGA |
| GTTCAAGACCAGCCTGGCCAACATGGTGAAACCCGTCTGTACTAAAAACACAAAAATTAGCTGGGTGTG |
| GTGGTGCACACCTGTAGTCCCAGTTACTTAGGAAGCTGTGGCAGAAGAATCGCTTGAACCTGGAAGGTGG |
| AGGTTGCAGTGAGCTGAGATCACACCACTGTACTTGAGCCTGGGTGACAGAGCGAGACTCGGTCTCAAAT |
| AATAATAATTTTTTTCCATAATGTTGTCTTCCCATATATATTTTACCAGCTTGAGGTAATAATAACTAGTA |
| AAACTTAAGCATTCAACCAATGCACAATGACACCATTTTTCTAATCTTCTCTGACTAAACTAAGTCTAAA |
| ATGGAATATTATTGACTAAATGTATCCCATCGACTATATTTGATTAATTAACCATCAGGTAAATTCTTT |
| CTCTCCTTAAGGAAGAAGAGATTGGGATTAAGATTGGTTATCAGTCATACCCTTGCCACATTGAATTGAA |
| TTCAGTTTTCAGAATGTTAATGCTTTAATAGGAAGTTTTGTGAATTTTCCCTTCAGATAAGAAGAAATTAA |
| TTTCTTACTTTTTTTTTTTGGTAAGAAATGTTTGTGTGTGGCGGGGGGGAGGGCTGCAGCCAACCA |
| CAGGTGATTTTAATGATGGTAATATATAGCACCTTCCTAGGACCATGTGGTTTAAAACATCGATGAGGTC |
| CTCTTCACAACATCCCTGAGAGGCATTTAGATATTGTCTTCCCATGTTTTTTGCACAGGGGAAATTCAA |
| GACAGACTGAGGTTAAGAAGTGAGTAGCCCAAGTTTAGTCAGCAGGTCAATTGCAAGTGAGAAAAGGAA |
| GTCCAGCTCTTTCAAACCACATCTCTTATCCTGGCTAATGAACAGCATCTCCCTGAGTCCATACTCTCAA |
| CTTTAAGATTCCACTCTAGGCCACTTTACTTTTTGAAGATCTGAACATTTGAATGAATCAGATACGGCTT |
| TCCAATTAGAAGTGTAGACAGTCGTGTCCCTCAAGGTTTCATTGTAAGGATAAATGAAGGTGGTGATGCT |
| TTTGAGCCCCTGGGACATAGGCCAGTCCCCAGAGAGGAGGAAGCAGCTCTGAACCAGCAGCATCCCTGAG |
| TTTGATTTGTTTATCAGAAGTAATGGTTTGGATAGAGCTGTCCACACTGTCATCCCATTTTATTGGTGAC |
| CAGGAACATATACCACAGAAAAGTTATGAATTATGAAACTAGGAGAAGGTGACAAGTGCTGGCTTTATGCT |
| GCTCTAGCTCTGTGTCACTTAACTCTTTTGGACCTCAGCCATGCCATCAGTAAAATGGAGGTCATGATGT |
| TAACTCCTTTCCGTTGTCTTTCATCCTTTGATTCTTCTAAATGCCCTTCATCGGAATCAAACTGGCAGCC |
| GTACACTTGCCAGGTCTATGCACACAGCAGTGAGCTCTGCAATCCAAGGACCAGATCCAAGTACAGATAG |
| GGCCCATGTTTTGCAGCTTTGCATTCTTTCTCCTCTACATTTCATCTCTGCCTGCATTCCATGTCACCTT |
| TGGAAGACCTCATATGTCACTGTCTTTCTGCCCTCATTGAACAGAGTGCACTACCCGTGAGCTTCCAGTA |
| TGGTGCCTTCTGGCAATCTACTTGAAGATATGATCTTCATTTTGTTGAAATCTAATACCCCATGTGAAG |
| AACAAGGACAGTACAACTCAAAATTCTGGACCACTGCATATGGTATCTTTTCTATACCCATATTTTAAA |
| TACGTGTATTAATTTATAACACAAACATATGGATGTTTCAAATAACGTTGGGCTATAAAAAACTGGTATT |
| GATAATTGTGACCCCAATGATGAGAAGCACTCATCAGAAGAAGAAGGAATTCCATTTTTTTTTTTAAGG |
| CAGGGTCTTGCTCTGTTGCCCAGGCTTGAGTGCAGTGACATGATTTCAGCTCCTGCAACCTCTGCCTCCC |

-continued

| Sequences |
|---|
| TGGTTCAAGCGATCCTCCCACCTCAGCCTCCCAAGTAGCTGAGATCACAGGAGTGCACCACCACACCCAG |
| CTTTTTTTTTTTTTTTTTTTTTTTAGCAAAGACAGGGTTTCCCTATGCCGCCCAGGCTGGTCTTGAA |
| CTCCTGACCTCAAGTGATCCACCCGCCTCAGCCTCCTAAAGTGTTGGGATTATAGACGTGAGCCACCTTG |
| CCTGGACAGGAAGAAGGAACTCTGTCTAAGCACATTTTTGGTTTTGTCCAGTCATGTTGTTTACACGGCC |
| ATTGTTACAAAGCAGAAAAGCCACCAGGCATCTCTTTACCTCTGTACAAGCATTCTAAATAGTTGAGAG |
| TTTGTGGTACATAAAAAGAAGCCTTCTCTCATGCTAATGTTTTCAAAACAAGTTGTGACTTCTGAAAGTA |
| GAGACCAAAGAAAGAATAACTTGAACAAGATTTCAGTGGGTAGAAAATAAACACTAACTTTATATGTATT |
| TCAAGAACGTAAAAGAAACAGGTGGGAAATGAATCCTCCTGATAAGAGAGAAATGCTTAGTAGGGTGGA |
| AAAAAAAAAAAGACAACATTCAGCAGTTTTTGGAACTGTGCGAGTCCAGAGAGTTTCTTTCTTTCTTTCT |
| TTCTTTTTTTTTTTTCTGGTTAGCTCTCATAGCCACAAATATGTATATTATTTCCTTCTTGCCCACAATT |
| TACTGAGAATCATCTTTCTAATATACTGGGGAATCCCAAATAAAAATCTCATTTTCTAAACACAGACAA |
| GTCTTTTAACTCCTGCAATTAAATGATTCAACTATTCATATGTAGACTGTAAAAGAAATAATCAAATTGT |
| TCTAGTAGAAATCTCCAACGGCCATCTCAAATAGTTTCCTTCCCAAATTTATACTGTAAACGGCTTAGGT |
| TTAGGGAGGGGTTTTGCCCTAGTCACTGATGTTTGAAATAGGACTCAGAAACCTCTTTCATAAAGTCTC |
| TGCGGTGATTGGGCTACCCCAGCAATGTGATATAGTGGTAGGATTACAGAATATTTTAACCCTTTTCTGA |
| ATGTTGCAATATATTCTTATATGGGAAATGATTGATTATTAACTACTTAGAATGTGTTTCTTTTCCAAGC |
| ATGTCAGCAGAGTAAGTACAGCAGACTTCGTAGGCGATCAGTGTAGTGTCAGGTGTGAGCAGTATGGACT |
| GGAGATGGTCTGCCTGGATTCAAACCTCTGCTCTGTCCTTTCCTACCCAGGCTTTTCTGGGGCTCCTTCT |
| GCTCATCTGCTAAGTGCCACGTATTACAGCATTTTCCTCATAGGGCTGCTGTGAGCTTTAAATGCGTTTA |
| TGAGTTAACTGCTTAGAACAGTGCCAGCTATGTAATAAACACTACGTAAGTGGCAGCTACACCATGCATA |
| AACAAACGCAAACTGTGTGCATCTGAGGAATAATTCTAGTTAACATTAAAGTGTGTTTTTGTGTACAGAG |
| TTGGTGTCTGTTGTCTGTGCATTCACTTTTTAAAAATCGGGAAATAGCAGATGTTAGGAACCTATTTATT |
| TTGCTTGCTCTTCCTTCTACTTTCTGCTTGCTACCTACTCTATTCTAGTTCCAGACTTGATCTGTTTCTC |
| TGTGCAGGGTTGCTCCTATGTACAACCAATGCAGAACTGACCCCATCAAATTTACAAAGTGTATTAGTCT |
| GTTTTCACGCTGTTGATAAAGATATACCTTAGACTGGACAATTTACAAAAGAAAGAGGTTTATTGGACAT |
| ACAGTTCCACGTGGCTGGGGAGACCTGACAATCAGGGTGGATGGTGAAAGGCACATCTCACGTGGCAGAC |
| AAGAGGAGAGGATCAAGTCAGATCTTACATGGATGGTGGCAGGCAAAGAGAGCTTGTGCAGGGAACTCCC |
| ATTTTTAAAACCATGAGATCTTGTGAGACTCATTCATTATCATGAACAGTGCAGAAAGACCTACCAGC |
| ATAATTCAATTGCCTCCCACCGGGTTCCTCCCACAGCATGTGGGAATTGTGGGAGTTACAACTCAAGATG |
| AGATTTGGGTGGGGACACAGCCAAACCGTATCAATAGGTATGGAAGGAAGTAAAATACTATTTTTTGGTA |
| AGAGCTCTCCCACTAAGATATGAGGACATATGCAGAAAGTGAGGAAATAAAACTCAAAGAAAGTGAGGAA |
| ATAAAACTCAAAATTGGCTTTCAAAAGCAAATTTTCTGTCAGTAAGATGTGACAGGAATGTTAAAGTTTT |
| AACAGGTTTTGTTTCCTTGTAAATATTTACTTCACTATATCTAATAATCTTTGTGAATGAAGATCTCATT |
| GGTGTCTTTTTAAGATATTAAGAATATTAGGATTACTTATATTTGAGGACTAAAAGATTGGTAGAGACA |
| TAATTCTATCCTTGTGGGTTCTTTGGATACTTTAATGCTAAAGTTCAGTACTTAAGATTGAATAAAAATG |
| TCTTGACAATCAGATATAAAATACCTTCTTTGGGCTGGGCACAGTGGCTCACGCCTGTAATCCCAGCACT |
| TTGGGAGGTCGACATGGGTAGATCACCTCGAGGTTAGGAGTTTGAGACCAGCCTGACCAACAGTGGTGAAAC |
| CCCATCTCTACTAAAAATACAAAAATTAGCTGGGCGTGGTGGCAGGTGCTTGTAATCCCAGCTACTTGGG |
| AGGCTGAGGCAGGAGAATCGCTTGAACCCGGAAGGTGGAGTTTGTAGTGAGACGAGATCACGCCATTGCA |
| CTCCAGCCTGGGCAACAAGAGAGAAACTACGTCAAAAAAAAAAAGAAAAAAAAACCTTCCTTAGTGTCAG |
| TCACTCTTTTTCTTTTCTTTCTTTTTTTTTTTGAGACAGAGTCTTGCTCTGTCACCCAGGCTGGAG |
| TGCAGTGGCGGGATCTCGGCTCACTGCAAGCTCCGCCTGCCGGGTTGACGCCATTCTCCTGCCTCAGCCT |
| CCTCAGTAGCTGGGACTACAGGCGCCCGCCACCACGCCTGGCTAATTTTTTTGTATTTTTAGTAGAGAC |
| GGGGTTTCACCGTGTTAGCCGGGATGGTCTCGATCTCCTGACCTGGTGATCCGCCTGCCTCGGCCTCCCA |
| AAGTGCTGGGTAGTCACTCTTTTTCTTAAGGTTACACAGTCATGGTTGACTTTGTAGGGGCTCAGGACAT |
| GCCACCCCAGACTATCATCTCCTTTTCCAAGGACTGTTCCAATATAATTTCTAGTACCTGAGAGACTTTC |
| TCTGCATAATAAGCACACTTGACCCACCATACAGAGCCTCCCCTCATCAACGCACAGCTTGTGTCCCCA |
| CCACCCCAGAAGCCCCAAGCCCCTATTCCGTTCCATAGCTCAGGATGCTAAATGAGTTTCAACCGTGTG |
| ACCCTTCTTCAAGTCTCATATTTTGTGGGACTCCCATGTGCACCTACCATCATTATTAAATATGGGGTTCTTT |
| CTGTTAATTTGTCTTACGTCAATTCATAACCCAGCCAAGAAACCCAGAGCGGTGGAGGAAAGCCATTTCT |
| CTCTCCCCTACAACTTTTAAATACTAAAATTAAAAATGTCCCCACCCACCAATATTGGAACTCCGTGGTA |
| TCCATAAGCTGGGTTGCATGTTAGTGATTGTAATAAGCAATAAAAATCCTTGCATGTCAATATTTTATTA |
| AATTTGATTATTCATGGATTTGTGACCATTATTATTTGCTGTTTATTGGTTTGTTGTTGTTTTAAAATA |
| TTTTACTTGGACTTATGGACCACATGTTTGTTTCAGAAATTCTTCAAAAGACAGCAAATCCCTAGTAAGT |
| GGGAAGAAAAATCACTTAACAGTATTCCAAGTACCTCAAAAGATGCAAATATGGAAAGATGAATATGAAA |
| AAGGGTACTCCTAGAGTTTATCAATTGTCTATCCCTGGAGAAAGTTTCCATTCTCCATTAAGACTCCAAC |
| GGCTTTGAATAGTATATGCTTTTGTGTATACAATGAAAATAAACCATCATCGTCATCATATTAACTG |
| GGCTTGTGCCCATTGTAGATTTCATGAAAAATAACCAACCATCAAAAATGACTTGACAGGAGAAGCCAAC |
| AAGCCCTAACATTAAATGGTCCTGTAAAAGTTTGCAGGTATATTATTTGTGTATTCAGTAATACTCTCAA |
| TTAGTGTTTATGACTTCATTAACTTAATTCATTTTTCATGAATGGTAAAAATTCACTCTTTCCTACATTC |
| ACAAATGATAGGCTATTTTGATGGAAAACCAAAGACTCACTATATGTTCTCCTTTGCAGTAGCGGTAGTA |
| GTTGCAGCCACCCAACTTCAGATGTGCAGTTCCTAGTTTACTATGTGATTCAGTGTGCTTTTATTGAGGGC |
| CTCCTTGTCGAGAGAGTATAATACACTAGCAGGAGTATATGTTTGGAGTCAAACTGTTCTTGGCTCA |
| GATCCTGGCACAGCTACTTGCTTACTGTGTGGTCTTGGGCTTCCTGGTCTGTAAAATACCCGCCCTGCAG |
| AGTTCTTGCTGAGTTGAAGTGAGAGGATGTATGTGCAAGTGTGCGGTGCGGCATTCGGTGGGTACTCCAC |
| AGCACTGGCTTCCCTTTCCTTCCACACTGGGGGCCTGCTCCTCTAATTCCTGTTCACCAAGTAGACGGGG |
| AGGAAGAGAGTGGTGCCTGAAACTACCATTTTTTTTAGTGAGTCAAACGTGTCATGTTGTGACATCTTAG |
| GCATGTCCCTTCACCCTGGGGGTCTTGGTTAACTCCTCTGTTAAATTCAGAGCTTGCCTTTTTTTTTTT |
| TTTTTTTTTTTGAGGCGGAGTCTTACTCTGTCACCCAGGCTGGAGTGCAGTGGTGCAATCTCAGCTCACT |
| GCAACTTCCGCCTCCTGGGTTCAAGCGATTCTCCTGCCTCAGCCTCCCGAGTAGCTGGAGCTACAGTCAC |
| GCACCACCATGCCCAGCTAATTTTTTTGGCATTTTTAGTAGAGACTGGGGTTTGACCATGTTGGCCAGGCT |
| GGTCTTGAATTCCTGACCTCAAGTGATCCACCCACCTCGGCCTCCCAGAGTGCTGGGATTACAGGTGTGA |
| GCCACCACACTTGGCCAGTTGACCTTTACTTTATGATTATTTCTAAAGCACTTCCAGATCTATCCTTCTG |
| TGATGCTATGATACTATGAAGCATTAAGTTGAGACTAGGAGATTAACAGTAGGGTGTTAAATGGACAGGA |
| CTGATCACAATCTTATATGGTGAAGGAAGAACCAATTGGACTTAGTGACACATTAAATGTGATTAGACAT |
| GAATTGGAAACTATTTTGAGGTAATGTTCCCCAGGATGCCCTCTCCAAAACACTAGTTGCTGAGGATGGG |
| AATAGATGTTAATTGAAAAAAGGTTTCTGAAAAGCATTTGGGAAATGCTAACTTCACCAGGTTTCTTTCC |

-continued

| Sequences |
| --- |
| TGCAGGACTTCTCTGATTCTTTAATATGCCCATATGCATGATGATTCTGAAATTGGGGAATGTAGTCATA |
| GTAGGAAGCATTTCTAAAGCTTATTTCTTCATGGAATCAGAATTATGTTGCACCCAAGTAGCATCTTACA |
| GGACCAGTATTTCATGGAAAATACTCTGTGAAGTGCTGCTCTATGATTTAAACCAAGAATGAGGTACAA |
| TATAGGGGCATTGACTCAACCCAGTGAATGTGCTGAGCACTGACCTCGCAAGATCCTGTGGAGGGCGGAA |
| ATGGATAAGATCCCACCTCTGCAACAAGGCTGGCAATAAGCCATTAGTGGTGGCATTGTCTACATGGCTA |
| ATAGCAGGGATGCCTTGGGGGAGACAATATCCCACCGAATTAGTGATGCAGATTCAGTTGAGGCAGTATC |
| CCCAGGGTGCAAAGTCCTGATTTCTCTCTCGGATGTGCTTATTCTCTGTCTCTCTATGAAGCTCTTATAA |
| TGGTATTAGCATCCAGTTCACCACGGAGAAATTCTGCAGATAAAATGAACGTAGGAGCTAAACCAATGGG |
| AAGTTTCATTCAGGAGAAGATTTTAGAAAATGGACTCTTTGGACTTCGTTTTTGAGTACATAGTTATTTG |
| ACCACCATTTCTACACTTGGCCTTAAAGTCAAAATATAATCTAAGGCGAGAAGTCTAAAAACTATGTAGT |
| AGACAACCTTGCTTTACTGTGAAGGACATGGCATCTCAATGTTGGCAGAACCTGACGACGTAGTTTGTTT |
| TTATTTCTCATTGATGAAAGATGAGCCAGAGGCCTGATGGCAGATTTTACTGGGAAGGACCTTTTCTCAC |
| CGGTCAGATCCGTGGATTATTTCACCACTGGATTTTTCTGCCTGTTAGGCCTTTGGAAACATTTTGGCAG |
| ATTGAGCAGTTATTTTGCTCATGTTGTGAGTAGCGTTTCTCTGACCTTTTGTTATTTACTGAAACAATCC |
| AGCCTGTTTTCTTTTAAGAGAAGCGTGAAATGAAGGGGAGTCAGTCAGCACATGCTGACTCTGGTATCAG |
| AAGGCTAACTTTTGGGCTGCTTGGCACCATGTATGCTTTTAAAGTTATGGGGTCATTGGCCTCTTTGTTT |
| CTTATTCCCATGATTTTGAAGGAGTCTTTTGGGGGAATTTTTTTTCCTTGCTAAAGCAGATGCATGTAA |
| GGTTAGTAATTAAAAAAATATATTTCACTATGTCTATAAACATAACCCTCTAAGTTTTCTTACGACATCT |
| TGGGCATGGTAGATTATCTGAAGCCTCTCCTCTTTTAAACATTGATGTGACGTGATGGGGAGGCCAGCTT |
| GGCACTGGAATGGTGGCTTGGTGACAGGGCATCCCTCACTCCTGACCTCTCATGACCTTGTGAGTCCAGA |
| CAGTGGAGGTGATGACACCATTCAGGACGCTCTCCACCAGCCGCAACAGGGAACTCCTTCTCCCTAGTGC |
| TCTGCCTACCTATGCCCAGAAAACCTATCTCCCTGATGTTTTTCTGGTTCTTCCCCTAGTAGAAGATTTC |
| CATTCTTTGCAGGTTGACTTGCAAGGATAAAGGAAGTACCAAGATCCTATTGTGGCCGGGCGCGGTGGCT |
| CACACTTGTAATGCCAGCACTTTGGGAGGTCAAGGTGGGCAGATCACCTGAGATCAGGAGTTCAAGACCA |
| GCCTGGTCAACATGGCAAAACCCCATCTCTACTAAAAATACAAAATTAGCTGGGGGTGGTGGCGGGCGCC |
| TATAATCCCAGCTACTCGGGAGGCTTAGGCAGGAGAATTGCTTGAACTTGGGAGGGGAGGTTGCAGTGA |
| GCCGAGATTGCATCATTGCACTCCAGCCTGAGCAACAGAATAAAACTTCGTCTCAAAAAAAAAAAAAAAA |
| TCCTGTTGCATCTTCAAAGATGAGAAAATGTGCGTGTGTATGTGTACTTGAGTATATGTTCATTCCTATC |
| TCCCCATCTATCTACCTGCCTACTGATCTCTTTCTAGCCCGGTCAGAAAATTCAATAGGAATCATGGCTT |
| TTCATTGGGATTCCCCATAGCACTTGAGCTCAGCTGCTAGTGTTGAAGACATCACTCAAATTTGTCTTGT |
| TTATTCTCGTAGCCAAACATAAAAATGATCATTACCTACATAAACTAACCTAGATGATCATTAATTGAGG |
| CTATTTAATAATGATCTGCATGTTTGACAATCACCATTGTCTAAGAATGGGCCATGGCTTTAGGAATGTT |
| TCATTCATTTCTTCAGTCTTTCAGTCAACAAATAACACACTGTCCTAGGTGCTGGGGACACAGTGTGAGC |
| AAAGGGACACAATTCTCATGGTGCCACATGGGCAATAAGTAAAACCGAAAAATAAGAACGTGGCAGACAA |
| CAAAATGGATAACGTAGGGTGTAACTGGGGAGGATGGTGATATGGTTTGGCTGTGTCCCCACCCAAATTT |
| CATCTTGGATCGTAGCTCCCACAATTCCCACATGTCATGGGAGGGAGCGGGTAGGATGTAATTGAATCAT |
| GGGGGCGGGTCTTTCCTGTGCTGTTGTGATAATGAATAAGTCTCATGAGACCTGGTGGTTTTATAAAGGG |
| GAGTTTGCCTGCACAAGTTCTGTTATTTTCTCTTGTTTGCCGCCATGTCTTTCGCCTTCCACCATGATTG |
| TGATTTATAATTTTCTTTATAAATTACACAGTCTTGGGTATATCTTTACCAGCAGCGTGAACACGGACTA |
| ATACAGGGGGAAGGCTAGTTTAAATATGAGTTTCACAGGACCTGTTTCTTTGGCTTGAGGCCTGTGAGAT |
| GAGGAGCCAGCCCTGAGAAGTCCTGAGGAAAAAACTTGGAGACAGAAGGAAGAACAAACGGACTCCTCTCC |
| CACTGAATGACCTCATGTATATGTTTGCCACTTGGGACTATGACCTGATGCCTCTTTAAACCTCTAGGTC |
| ATTGGGAACATCCACAAAACAGCTGAAAGATGCTGTTTTGTTAGAATGCTCGTTGTAATGCAGGATGCTG |
| GTGAACCCAGTGTGAACTTTTCAAAAACCTATTGATCCCACCCCACCCACTCTCTAGAGCTCTCATATTG |
| ACAAAGGATACCTTTCACAGATTAGAAAGTCAGTAGACTCCCATTTCTTAGAGGAAAGTTGTGGAAAATAC |
| TTAAAAATACTGTGAGTAGAAGAAAGAAGCAGTTTAGAGCTTCAAATTCAATCGGGCTAAGTTGGGCAAG |
| CTACTGCCTTATAGGCAGTAACTTTCTCATAGAACTTTAAAAAGTTTTATTTTGCAATAATTTATAGACTT |
| GTGGGAAGTTGCAAAAATAGTACAGAGAGGGCCCATGTACTCTTCATCCTGCTTCTTGAATGGTAACGTC |
| TTGCATACAATAGTAAATGGTATCATGTATATAGCATCACATTACCAGGAAACTGACGTTAGT |
| ATTAGGCCTTAAACAGATTTCACCATGGTTTATGTGCACTGATTTGTATGTGTGTGTATCTCACCCCA |
| TGTCTAGATTCCTGTAACCACCACCGCCATCAGGACACAGGGTTATTCCATCCCTACCAAGAAACTCCCT |
| TGTCTCCCTGTACTTTTATGTATGAGAAATGGCAGCAGATGCTGTCCTGCTTTTAGTCTGAATCATATTC |
| TGGAAAAATCTACAGTGAGAGAAGGTGGATGAGTCTTTGAAATCTATTGGTTGAAATGTATTGGCACTGA |
| GAATCTGCTTAATTGATATAGAAATGGAGTTCCTTGGTCTGACTTATATGAAGACCATCTACAAGCTCAG |
| AACCAAAAACACAGGTTTGAATAAGTAACCCTGAGCACATTATGAGAGTCCATCAGTTGATGCTCAATT |
| GGTTTAAGAAGCTAATACCAGTCATGTGGCCTGAGTAGTTTATTTCTAAGAAGAAAACTCTTTCTGGCAC |
| CACACAACTTGGGGGATTAATAATATATATATGGAGCGTTTGGCACATTTCTCGAAGATGACCCAGGAAG |
| CAGACACACCAGTAATGGGTTAACAGGTCACCCGAAGAGTGGGTGCATTCCTTATGGAAAACAGAACACA |
| TGATAGAAAAATAGCCTTTTGTGTGTGGAGGCAAGAAACCTTTAGGACGTGCAGTTAGCAGTGAGAACTT |
| AAGGAAGGTGCAGGCTGAAATGGAAACACGCTATAAACAGATTGAGAGAGAGACAACAGCTTTAAGGGAA |
| AACATCTGTCTGGTGGATCTGACATCCAAAAGTTGCATCTGTGGTCTAGGACCAATCTTGTAACGCTTAA |
| AAAAGGAATCCACAGAGGCCCAAAGCGGGCTCTGAAAGTTTCTTTCTTTCCTTGAGATTTTCTGTTTGCT |
| CTGCCCAGAATACTGCCTAGGACGGATGAAATGAACTCATCTGGTCCTGTTTCTCAATGCTGAAGTAGCA |
| CGCCAGAGAAGTTAACTTTAGAACAGTTGGTTGCAGCAACATTTTACCTGGATTATTCTAGACATACTGA |
| TAAGGGGAGTCCATTTACTCTGCCAAACGAAACTTCTGGAAATCTTTTTTTTAAAGACAGTCTTGCTCT |
| GTCACCCAGGCTGGAGTGCAGCGGTGCGATCTTGGCTCACTGTAACCTCCGCCTCCTAGATTCAAGTGAT |
| TCTCCTGCCTCAGCCTCCTGAGTAGCAGGAATTACAGGCACCCGTCACCATGCCTGGCTAATTTTTGTAT |
| TTGTTGTTGTTGTTGTTTTGAGACAGAGTCTTGCTCTGTCGCCCAAGCTGGAGTGCAGTGGCGCGA |
| TCTCGGCTCACTGCAACCTCCGCCTCCCAGGTTCAAGTGATTCTCCTGCCTCAGCCTCCCGAGTAGCTGG |
| GATTACAGGTGCCTGCCACCACGCCCAGCTAATTTTTGTATTTTTGGTAGAGACAGGGTTTCACCATCTT |
| GGCCAGGCCAGTCTTGAATTCCTGACCTCACAATCTACCCACCTCGGCCTCGCAAATGCTGGGATTACA |
| AGCATGAGCCACTGTGCCGGGCCTAATTTTTGTATTTTTAATAGAGACGAGGTCTCACTATGTTGGACAG |
| GCTGGTCTCGAACTCCTGACCTCAAGTGATCCACCTGCTGTGGTCTCCCAAAGTGCTGGGATTACAGGCG |
| TGAGCCACTGCACCCGGCCGCGAAACTTCTAGAAATCTTGAGAGTGACTCTTCCAATATTTTGTATTTCA |
| AGTAGAAGTTTTCAGTAATAATGAAGTTGAAAGCCAGAAGAGAGGAGCAGATAATGTTCTCATGAAGCCT |
| CAGAAGACATTAGGAGCATCTATCTCGATATTAGATTGAATTGAAAATTTGTCATATTAGTCCCTTGACT |
| TATTCATATTTTTTCTCTTGAGCCATTGGTTTGTGTTCTGTAAACACAGCCTAAGAGGCTATTTTAAAGG |

-continued

| Sequences |
|---|
| AAATGGAGATCAGGTGTTCTCCATAGATTCCCATGCTCGATTTCCCGGAGTGGGAGCAGGAGAGAATTAT |
| GAGCAAAGAGTTTCAGCCCTCACCCTGGGACATTACCCCTCCTCCCTGCACAGACTTCACAGTGGGATGC |
| TGGTGAATTTTTAATGTTAATTTTTATTTTTAAATTTAACTTTTATTTTAAGTTCAGCGGTACATGTGC |
| AGGTTTGTTACACAGATAAACTTGTGTGATGGGCTTTGTTGTACAGATTATTTTGTCACCCAGGTTTTA |
| AGCCCAGTACTCATTAGTTATTTTTCCTGATCCTCTCCCTCCTCCCACCCTTCATCCTCTGATAGGTCCT |
| AGTGTGTGTTCCCCTGTATATGTCCATGTGTTCTCATCAGTTAGCTCCCACTAATAAGTAAGAACAT |
| GCAGTATTTGGTTTTCTGTTCCTGATGTTAGTTTACTTAGGATAATGGCCTCCAGCTCCATCCATGTTCC |
| TGCAAAAGACATGATCTAATTCTTTTTTATGGCTGTATAGTAAGTATTCATTCCATGGTGTATATGTACC |
| AAATTTTCTTTATCCAGTCTATCACTGATGGGCATTGAGGTTGTTTCTGTGTCTTTGCTATTGTGAGTAG |
| TGCAGATGCTGATGAATTTGCACTTCATATTCAGTGATTTTCGCCTTGAAGAACATACCTTACCCAATCC |
| ATGTTACTTGAAGACGACCGTAACTGAGGTGTAGGAATTTGTCCTAAATTACTGTAAACAACTTTTTGGG |
| GCATTTCACAATATTCCAGCGCCTCTCCGTTCCCTTTCATTGTCTTCTCCACCTGATCCCTCTTTCAAAC |
| TCTTGTCTTTATTTTTATACATCTTACCCCAAACCCAGATTGCAGTAAGATTCCTATGTGCATTGCCACA |
| TGCATTTTCAGCAATTTGAAATTTTATCTAATATCAATTAAGCTGGTATAAATCATACCACTTCACATAC |
| GTGAAGTTGTTTGCTACAGCCCTGTTCTGGAGAACGGTGAGAATGCCCTCCTTGTTTTGTGGCAGGGGTG |
| AGGGGGGATGTTTTAATGAGGAGAGACTGGTAATAAGGGATTGTGGTGAACTGGCAGGGGAGGAAATTCA |
| ATAAACAGAAGAGAGGAACTCAGGATAGTTGGGCACTGGAGTGTTGCAAATAAAGCAATATGTGATGCTC |
| TCCCCATGGAATGCTCACCTACGCTATACTCAGAATCCCTGACAGCCGTTTTGCACTCTCCAACACTGGC |
| ACACAATGGGGTCTCAGGGTTTGTTGAAATAAATTGGGCTCTATATCATGTGTTCCCTGATTTCTCCTCA |
| ATAATGTGTGCTTCCCAGCCCTGCATTGAAAATTAGGACATCAAGTGAGATTGAAGTCAGATAATCTGCC |
| TCATGTCACATGGGTTGAATGTGGTAGATGTGATCTCAGGTCTTTTGACTGCCTCATGGCACCTTCCATT |
| TCCAAGCCTCTGTTTTCTCATATTCTTAAGGCACAGAATTCATCCCATTACTTGGTCTGGTGTTGAGGAG |
| AAGCTTGGCATAATGGAAAGACTCAAATTTCATTTTTTTTCCTTCTTAGAAGAAATCTGTAGAACTGTT |
| TCATCACAACCTGTGGATAGCTGACGCAGTTTGAAGATCTCACCTTGGAGTCACCCATCTCACAAAATG |
| TCAGCCGGGGTGCTCATTGGTACATTGTTTGTTGTATATTTCCTCATACCTTGGAAAGGACTAGTTGAAT |
| TTGTTCCAAACCAAGCAATTGACCTAGGACTTTGCATCCTATTAGTGTCGGCCACAATTCAAATCCAACT |
| CCTTTTCAAAGTTGTATTTTTTACGAAAGGTGACCTGATAGCGAGACAAGAGTAATGACGGGTGAGGCAC |
| TCTCAAATCAGGCCAGGGTGGCAGGCCGGGACATCTTGTTTTCATCAGATTCTCGTAGTTACTCTTGACT |
| TTTCTGTGTGTTTGCTGAACTTGTGAGATTCTATTGTGCTCTTTCTAGCTGGATATTTTCCAGAGGGTTA |
| TCAAGAAAAGGAGTATCTTCTGCATTAATAACCTCGGGAAGGATTTTAGCAGTAAAATTAGAGACCAGA |
| TGATCTGCTGGACAGCAGGATGGGGGAGCATTTCTTCCCCTTTCCCAGGAGAGTGTCAAGTTCAGCATGA |
| CCTAGCACCAGACCTTTCACTCAGTAACTCTGAGATCTTATCATATCAAGTTATCTCAGTCATGATGACG |
| TAAATGGCAAAACTACTACCCTTATTTCTTGGGATAAGAATTTTTCGCTTTAAAGGAATACAATATACAA |
| AATAGGTGACCATGAAATATGCTTGGTGGGTCAGCTAATTTCCATATGTGCTTTGTGATTGGTTTTTAAG |
| TGAATTTATTGCTATAGAGTTCCAAAACAACCCTTTAACATTTATGTTTTCTGCACTTTGTCTCATTATT |
| GAAAATAACAAGCGCTATGTAAAAGCGTAAAGAATATACTAAGGTTTACAGCAAGGATAACCACGAAAGA |
| CCGGGAGTTAGAAAGCTATGGCCTGTGGGCCAAATCTTGCTCACCACGTGCTTTTGTAAATAAAGTTTTA |
| TTGGAACATAGCTATGCCCATTTGCTATGTATTGTCTATGTCTGCTTTCACACTGCAACATCAGAGTTGA |
| GTAATTATGATAGAGACCATATGGCTTAAGATATTTGCTATCTGGTTTTTCACTGGAAATGTTTTCCAAC |
| CCATGCTATAGATATTTTCATGGTATTTATTTACTGACTCGTTTGTTCATTCTTTCAGTGGACACCAACC |
| CTGTTAATGACGCTGGGGAATGTAAAGATAAGTACATCAGTCTCTAATTTCCAAGAGCTTATAATGTAAC |
| AGAGACAAGTTATGTACTCAAATAACAGAGACAAGTCATGTATTCATCTTTACCTCTGACCAGGCAGAAT |
| GCAGCACGTACTACAGACAAGAAATAGCTAAATTGCTGTGGTAGTTTAGAGATGATGAGAGCCTCCGACA |
| AAGGCAGGGAATTGGGAAATGCACAAAGATATTGCTTCCATAACTGTGGCACACAGTGATTTCCCAATAG |
| GGAACTTCATGAGAAATCAGGCTAATTTCCTTCATGGAATTTTATAAATTGTAGTATCCAAAAGAGTGGA |
| AGTGATTTAGAATATTACTTTGTGTCCAGATTCCTTTATCTAGAAGCATATTTCCCCTGTAACTATGGGG |
| ATGATCATATTTATAGAAAATTTTTGAACATTTGAAGGAAGGCTTCCTTTATCAGGGTGGGAAGACAGAA |
| GGAATTCCTTTTCTTTTTTGCTGATTGTTCACTTCACAGTGTAATATTAAATGCTATGGGTCTTAAAGAA |
| AGGCTTCTGTGGGGAAACCCTCAAATATCAAGTGGACTATAAAAACAAGATAGGCTGGGTGCAGTGGCTC |
| ACAGCGGTAATCCCAGCACTTTGGGAGGCCAAGGTGGATGGATCACTTGAGCCCAGGAGTTCAAGACCAG |
| CCTGGGCAAGGTGGCAAGACCCCGTCTCTACCAAGAAATACAAAAATTAACCAAACGTGGTGGCACGTCT |
| GTAGTCCCAGCTACTTGGGAGTCTGAGGTGGGAGGATTGCTTGAGCCCAGGAGGGAGAGATTGTAGTGAG |
| CCAAGTTTATGCCACTGCACTCCAGCCTGGGAGACACAGCGAGACCGTCTTAAAACAAACAAACAAAA |
| AATCAAGATAAAATTATAGAACCCTAACCATGGAATAGCAGGACTCAGTGACAATTACATCTCTCTTC |
| TCCACAATGCATGCGAGTGTGAACTGAGATTTTGGTAAGTTCCCATTTCCCTTTGGCCTATTGAACCCCT |
| TTAAGGGTTCAGCCCCCAACCCTGGGAAGATTCCATGCATGAAAACTACCCAAATCCTCCCAGTTGGGAT |
| TAATGTGACCTGATAAAGAGTTCTGATTTTTTTTTTTTTGAGACAGAGTCTCTCTCTGTCTCCCAGGC |
| TGGAGTGCAGTGGCGCGATCTCAGCTCACTGCAACCTCCACCTCTCGGGTTCAAGCAATTCTCCTGCCTT |
| AGCCTCCCAAGTAGCTGGGATTACAGGCATGCATTGCCATGCCCGGCTAATTTTTATTTTTGTAGAGAC |
| GGGGTTTCACCATGTTGGCCAGGCTGGTCTCAAACTCCTGACCTCAGGTGATCCGCTCATCTTGGCCTCC |
| CAAAGGGCTGTGATTACAGGTGTGAGTCACTGCGCCTGGCCTGATTTTTGTGTCACCAGAATTGCCTTGT |
| CCATTATTTGTGTTTTCCAAATATCTATTGAATTAACTCGAATTGGATGCAGACAGACATTGTGCACTCA |
| AAACCTAGGTGATTGATTTGGAAAAAGATTCAAGACTTTTAGGTTAGTCTAAGAGATGCTCAGGGGAGGC |
| CCCTTCCATTTTGCTTCCAGCAGGGTGTCAAAGTTATTGGCTAAATTCCAGCCTCCCTTTCTTTATACTC |
| ATAACAATAAAGGTACCAGCATGAATGCAGCAGAGTTTTGTTTTAGAATATAATCCTGTGAAGTTTTACC |
| AGCCGAAAGCATAATATTTGGATGGATAAAATGTGTGTTTGGTGAAGAGCTACTGAAGGAACATAATAT |
| TGGACCCCAATCAGGTAATTTAAATGTTATAGGAAGCACCAAGCCCACCTATTTCACAGGCCCCCGCCT |
| CTCCCCTACCCGGAGTAGCAGGGCTCCCGCAGTTAGCCATCCCACAGCTCTCCAGGGGCTCTGCTCTCTC |
| GTTACCAAGAAGCACATGCCAGCCCGTCTCCCAGCGTTTCCTGGTCCTTTCACAATAGACAGATGGGGAT |
| GCTCCAGGTAGAGACAAAAGAGAACACACAATCCATACGCTCATCTTGCTGGTACCCTTCCGCTCCCTGA |
| GCCCAAAGAGGGAGAACCCAGCCCTCTGCGTAGGAAGAACACATTTCAAGGCATTTACTGACAAGTAGGTA |
| TAGTTACTGCATACACATGTGGAGGCTGCATTATATCAAAACTGTAAATAAACATAGACTCTGCACACTC |
| CTTCAGGCCCCACCATGTATTTATGAATGGGATTGCTTCATCATTTTCTTTTAATGTCAGTAGCAGGGAA |
| GTCAGAAAGCATTACCTCTAAAACGGGGACAGAACATTGCAAATACATACATTTCCAACCAGCTGTGGCA |
| ATAACCAGCAAACAAAATTACTTCACCCCGTTGTTATGGGCCCCATGCCTATGGGATTTTTCCTGAGTTT |
| CTGATTTATAACAATCACTTTTGAAGGCCTCAAAATGCTTAGGTGAGATTAAATTACTGATTATCCAAAA |
| GTTCTGTTTTCGCTGGAGTCTTTCTGGACGGCTGCTGATTCGGTCCCATTTAAAGCATTCGGTGGCATGA |

| Sequences |
|---|
| ACTCACTCGGTTTCTGCCCACATCACTGCATTCCTGGGATGCCGTTCACAGGCCTTAGCAAGATCATCTG |
| ACAGCCGCCTGTGAGGTCAACGAACTTTATACATAATTAAACACTCCCAGTTAGGAGAATTCATTTCTTT |
| CTCCCTGAGAAGCAGAGAAAGAATACATGTTGTGTTGCCCTCCATTACGGAGTAAAAGTTGTGTGGAGTA |
| ATCAGGCTAGTTTCACATGATTTAATGTTGAACCGAATAAGAAAGTGATTGCATCCTCTACTGGGCCTCA |
| CAGAAAAGTCACCACCCACATTGTTTATTCAGACTGGGATCTTGGCCATTTGGGGTTTAAGCCAGAAGAA |
| AGAGGAAAAAAAAAAAATCCAACCCTGGAATGAACGCTTTTGAAACTCTGTATTCTTGATGAAATGCGGC |
| CAAGGGTTCTTTTAAAAAAAACTATTTAAAATCAATTACCAAGATCATATTTTCATTTACAATGGGTTGT |
| TAGCAACAGCTAATTCTCTGTTTCCATCCAGATTTGGTGTTTAAGCTTCAATATGCTGGTATTGGAATCC |
| TTGCCGTGTTTTGTCTGGGTATCAGATGCTACCACCCAAACTATGTGTGGGGAGTTGGGCAACTCTGACCT |
| TTGACCAGCTTTCCATAAAATAACAAGGAAAGGTGTGAGGAGGCTAGGGATTGGGTGAAAACTAGCCTGA |
| GGGATGGCAGTAAGTGAGCTTCACCAGGGGGATGAACATATAAAGGAGGCACTGAGGGATATTGCTAAGGG |
| TAAGAGAAAGCAAAAGACAGAATCATATGCCTTGGGAGGAGGGTCAGGCCCGTTAAGGCACCTAGTCCGT |
| CTGTCTCTAGCCAGGACTGCAAGAAATCATCTCAGACATGCGATCTTGTATCGCATTTTTAAAGATCTCA |
| AGAGGAGATTCCGGAACCTCCCTTGGTCATCCGCCCTATTATTTAACAATTCCTACAGCCAGGAAATTCT |
| TTCTTATTTCCAGCCTAAAATGTGCATGTGGTGCAGCTTCAGGGGAGGTGATTGATCGAGGCCACGCCCA |
| CCTCCCCCCCGCCTGTTTACTCCTTGGATGGGATGGTGCATATGTCTTGCTTCTTCCTTAAAATGGGCCT |
| CTCTCGGCCTCCATACCACAGTCCCCGGGCTGGGAGAGGGGTCGTGGTATAGAGGTGGGGTGGGGGCCGA |
| CCAGCGGCGTTTATGGGGACCAGCCGCCACCAGGAACTGTTGCTAGGCATTTTATGTATTTCCCAGAGGC |
| AAGAGAACATAGCTGTGATGTGGCCAGGAGTGCGCCTCAAAACCACGTGCAAATAATAAATGCGGAAGCT |
| CCCGTTTCAGATTTTAAAAGAAAAGAAAAAATCCTGAAAAACAGAATGAAGAGTCTAGAATTTCA |
| CTGGCCTCGAGATGGTAGTCTACTCCTCAATTTTAAACAAGAAGAGCCCAGAGCAGAAAAGGGACCTGTC |
| CCGGACAAGATCTCAGAGCTAATGCCCCTAAACGCAGCGCAGTGCCCTGTTCTTAATTTAGATAGGGTGC |
| TGGAAAGGCGAAATCATGCTGGAACGGAGGCCATCGATCTCACTTCCTCCGGCCCCTTCCTCCTCTTCGG |
| CAGATGCGCAGTGAATGGTCAGGCCCTCCGTGAGTGAATTACAGATTCATTGAAGAGCCGTCAGATGACT |
| GGAGCAGTCTGGTTTCTTCCCTTTTTATCGAGTTCTGTCATTGTGTTCCTCAAACTGTGGTTTGTTCCAG |
| AAAGGAAGAGGTTGTCTTCTTCACCCGCCTGCCCTAAGTTGCGTCAAGTTCCAGTTCCCTGTATTAAGTA |
| AATTACTAAATGAGTGGAATGAACATCATAATGTCAAGGGTAGGGCGTTGACATTATGGGACAATAGACC |
| ACGAGCCCACTCTGTCAGCTTTTTGTCCCGCACCTCTATTATCTGTCAAATGATCATATTAACACTCTCC |
| TACCTACTTTAGGGGGCTCCTAAAAACAAATATTTATTGACAGGTTATGTATTAGTCTGTTTTCATACTG |
| CTATGAAGAAATACCCGAGACTGGGTAATTTGTAAAGAAAAAGTTTTAATGGACTCACAGTTCCACATGG |
| CTGGGGAGGCCTCACAATCTGTGGAAGGTGAAGGAGGAGCAAAGGCACGTCTTACATGAGGGCAGGCAAG |
| AGAGCCATGTGCAGGGGAACTCCCATTTATAAAACCATCAGTATTCTGTGAGACTTATTCAATATACGAGA |
| ACTTGGGAAAAACCCACCTCCATGATTGAGTTGCCTCCCACCAGGTGCCTCCCATGATACGTGGGGATTA |
| TGGGAGCTACAATTCAAGGTGAGATTTGGGTGGAGACACAGCCAAATCATATCATCTTATAAATGTAGAA |
| CACAAACTCCATGATATCCTTTATATAAAGTTTAAATACATTTAAAAATATATATATATAGTTTAAGGAT |
| ACACACATGTGAAAGATAAAACCATGCATGGTGATAATGACGCATTGAGCATCACACAGTATTTTTTATT |
| GTGAAAGATCTCGAGCAAACAGAAAATGCAGAGAATAAGATTGTGTATAAATGTGCATTCACCACTATTT |
| TGTCATGTCCTTGTTCTTTTTTGTAAAAAAGAGATAGACTTTCCCCATTTCCACCCGCTTTTTCCTTCCC |
| TGAACGTCACAGTCATCAGTTTAAATGTGATGCTCAATGCTCATTATAACCATGCATGGTTTATCTTTC |
| ACATGTGTGTATCCTTAAACTATATATATATATTTTTAAATGTATTTAAACTTTATATAAAGGATATCAT |
| GGAGTTTGTGTTCTACATTGTATTTGTAAGATTTTGTCCGTTGCAAAACATGGACCTCTATACATTTTCA |
| TGCTGTGTTGTAGTTATCAGATGGAGGACATGGAAGTTATTTCTAATTTTAAGATGTCCTTTGGAAGAAT |
| GCTACAGGTGTGTCTAGCTTTTTGATATGTTCTTTGCACACCATGCCTGGTAGTTTCTCTTGGATATGTA |
| GCCAGTAGCAAAGTGATGAATTAGCACATCGTCTTCCCTGGATGTTGCCAAATTGCTCTCCAAAGTGCAA |
| GCCCCTTCTCAGCAGCAGGGTCTGAGAATTCCTAATGCTCAGTATTCTCTTCAATACTTGTTAGAGTCAT |
| ATTTAAAAATTTTTTTCCTTTGCCAATCTGATAGTTGTTTCAGGTTTCAGTTGCAATTTCCTGATTACCA |
| GTGAGGTTGAGCATATTTTCATTTGCATACCGAGTAGTCAGGATTTCCTCCATGAGTTATCTCTTTCTTT |
| CCTTGGCCCGTTTTTCTATTGGTTCGTTGTTTCTTTATTGGCTTATTGGAGTATGTAATGTATGCTTGAC |
| ACCACTCCCTTGTCCATTATATGCACAGCAAATATCTTCTCTTGGTTTTGTAATTTTATTTTGTTGATGA |
| TGGTCTGCTAAGAGATTTTCATTATTCCTTTTGTTTTATTCTCATAAGAGATCTGTGAGCTAGATGCTAT |
| CTCTGTTTGCATTTTAGATGAGGATAGTACATCTTAGAGAGTTTAAGTAAATTGACTAAGGTCTCACAG |
| CTGGTAAGTAGCAGAGCTGAGGATCAAGTCCAGATCGAATTCCAGAGCCCATGCGCTTAACCACTGCCTC |
| TAAGTCATAACTACTATGAGTATCCCCATTTTACAGATGAGCACACAGATAAGGCCCAGAGAGGGTTCACT |
| GATTTGCTCAGAGTCACTCAGCGTGGTAGTGTTGGAACAAGGACTGTTCCTCAGGTCCCAGACTGCCAAC |
| ACAACTGTATACCTAGATTGAAATGTTGGGGAAATGATCGGTGATAGACTAGATAAAGGAAATGTGATAC |
| ATATACACCATGGAATACTACGCAGCCATAAAAAGGAATGAGATCATGTCCTTTGCAGGGACATGGATGG |
| AACTGGAAGCCATTATCCTCAGCAAACTAACACGGGAACAGAAAACCAAATCTGCATGTTCTCACTTAT |
| AAGTGGGAGCTGAACAATGAAAACACATTGATGCAGGGAGGGAGCAACACACACTGGGCCTATTGGAG |
| GGGCAGGAGGAGGGAGAGCATCAGAATAAATAGCTAATGCATACGGAGCTTAATACCTAGGTGATGGGT |
| TGATAGGTGCAGCAAACACCATGGCACACGTTTACCTATGTAACTAACCTGCACATCCTACAAATGTAT |
| CCCAGTGCTTAAAATAAAATAAAATTAAATTTTAAAAGAAAAAGAAAATGTTGGGGAAATGTGCAGAAAA |
| AGATCATGTATACCCTTTTAAACAGTAACTTTAAAAATTATGAACTATTTAATATTTAAAATACAAAATT |
| TACAGAGAATAATATAGCAAACAATCAGGTACCCCAACTCAGATTTAATAAATATTGACATTAGCCACAT |
| TTTAAAAATATTTTTAACAGAAAATGTTGTAGTTTAAGCCTCTTTTGTGACCCCAAACTGACAGCATTC |
| TTCCACAGCTTTCCCAGCAGTAAACACTCTTTAGAAGTTGCACTGTTACATACCTGTTGCATTTGCTAT |
| GTGATTATGTGTCATAAGCCAGGGTCCCAGCCCCCAGGCCATGGACCGGTACAGGTCCGTGGCCTGTT |
| AGGAACCTGGCAGCACCGCAGAAGGTGAGCTGCAGGAGAGCCAGCATGACCACCTGAGCCCCACCTCCTG |
| TCAGATCAGCCACGGCATTAGATTCTCATAGGAGCGCAACCCTATTGTGAACTGTGCACCCGAGGGATCT |
| TGGTTGCTCGCTCCTTATGAGAATCTAATGATAAATGTAATGTGCTTGAGTCATCCTGAAACCATCCCCC |
| ACCCCGTCTATGGAAAACTGTCTTCTATTAAACCAGTGCCAGAAAGGTTGGGGACCACTGTCATAAAC |
| AATAACTAGTATCATTTTGCAAGTTTAAAAAACGAATGGTAATGTTATCAATAATCATCTTTCTGGAAC |
| TTGCTTTATCACTTGAAGTTATGTTTCTGAGATTTATCCTAATTAATGTATGTAGAGCTAATTCCTTTAA |
| CTGTTATATTGTTATAAACTGAATGTTTCTTTCCCTGCAAAATTCATATGCTGAAATCCTAATCCCAAAT |
| ACGATGCTATTAGGAGGCAGGATTTTGGAGGTGATTAGGTCACAAGGGTAGAGCCCTCATGAGTGGGTTT |
| AGTGCCCTTCTAAAAGAGACCCCACGGAGCTCTCTTACCCCTTCACTGTATGAGGGCACAGTGGGAAGGT |
| CCTCTATGAACCAGGAAGTGGGTCCACACCACCACATCTGCTGGCTCCTTGATCTGGGATTCCATCCTTC |
| AGAACTGAAAGATAAATGTTACATAAGTCACCCAGTCTATGGTATTTGTGTTATAGCAACCTGAAAAGAC |

-continued

Sequences

```
TCAGACATAAACCAATTTCTTTCTATAAATATATCATAATATATCCACTCCCTAACTGATGTTTCCAGGT
TGTCATTTTATAAACAGTTCTATTGTGACCTTCTCTGGACTTGTTTCCATGTGGATTTGTTGAACTTTTC
AAAGATACAGAAGAAGTGGAATTACTGGGTCTTGGGGTACAAACATCATAAAGGTTGGTAGGCGTTGCCA
AATTGCTCTCAGTTTGCTTTCAGCAACAATGTGTACAATTCTTATTATTCTGCATCTTCTCCCACTCTTG
ACATTGTTGGGCTTTTAAAATTTGCTAATCTGATGTATTGAAAGGTATTTAATTGTCTTGATTTGTATT
TCTCTGATTACTTATGAGGTTATGTGTTAGTGTTGGTTTTTCCTACGGTTTTTCATCATTTGGGATTTT
TTTCTTTCTCTTTGTATTACCTGACTCTAGACTTTGCTCACTTTTTTGTAGTGGGTTGTTTTTCCTTAT
AGAGTACTAAGTGTTCACTAAATATTATGAATACTTACAGAAATTTTCTCTCTCCAAGGCTATTTATTGC
CTTTAAACATTGTTTTTTGGCATCCTTCATCACAGAATGTTTAACATCAAATTTCTCAATTTTATCTTCT
TTCCTTCTTCTTCTTTTTTACTTTATGGTTTGTATTTTTTTTGTCAGTCCCTCACTTAAGACCATAAAA
ATAGTGTCTAAAAAACATTTTTTCCTAAATGTTTTAAAGTTAACTGTAATTCTCTTGGAATTCATTTTTG
GATATAGTGTGAGTTAGTGATCTATTTTTTTTCTCCATATGGGTAACAGTTGTCTGCGAACCACCTATTA
GTTTAGTTTTGTTTTCCCCATAGTTTGTAATGCTATCTCTGTCACATACCAAATTCCCACATGTGTGGG
GCTCTCTCTATTGCGTTAGTCTAGTTATCTATATTTACACCAATACTATAGTGTCTTAATTTTATGGCAT
AATTAAGTATATTGTATATGTCTTGATATCTGGTAGGACAAGTCCCCATATTATTCTTTTTCAAAGTTAT
CTTGGCTGCTTTTGGACCACAATTTTAAAACCGGTTACAAATATCCATGAAGAAAACCTTTCTGGGATTT
TTATATGAATTTCATTCAATTTATGTATTAATTTTAGGGGATTTGATGTTGAAATTGTGGAATCTTCTCA
CTCCTGAGCATGAGATATATCTCTGTTTATTTAGGTCTTATGAGTTTCAATGAAGTTTTATAATTTTTTT
TTCCATATAGGCCTTGCACCTCTTTCTTTAGATTTATTCCTAGGTACCTCACAGGTGTAAGATCTCTATT
GCTAATGACATCTTATGAAAATTACATTTTCTAATTGGTTGTTACTGATGCCATGGATGTTTGTATATTA
ATCTTGTCTCCAGCGTCCCTGCCAAACCCTCTTATTTCTTGTAATTGTTCATAGTTTCTCATGGATTATC
TATGTAGACAATCTTATCATTTGCAAATAATGCCACATATTCCCCCTTCATTTCTAATTCTGATTTTCTT
ACTCCTTTTTCTTGCTTTATTACATCAGCAAGGTATCTCATACAATAATGAATAGAGTGGTGAGAGAGAA
GACATATTTATCTAGTTGCTGATTTTAAAGGAAATGTTCCTAAAGTTTCTTGTAGGTTCTTAGGAGAAAC
TTCCTTCTGTTTCTGTTGGCTAGGTATTTTATTTTATTTTTAAATTGTGAATGGGGGTTAAATTTGTTAA
ATGATTTTTCTGCATCTATTGAGATGATTATATGGTTTTTCCTTCCTAATTTGCCAATGTGGGGAATTAC
ATTAAGATTTTCTAATGTTGACTCTTACTTGAGCTTCTGGGATAAAACCTACTGGGTCATCTCACACACA
TTCCGTATATTTATTGTGTGATAAACATGATATTTTGATAGATATAATCTCAAATATGTATATTAAAGAA
ATACTATATATTTGTGCACACACTATACTGCTGGAATTTTTGCTAATTTTTTTTTCAGATTTTTTGCAT
TGATACTTTAACTGAGATTGACCAATACTTGCCTTTTTTTGTATTGTCTTAGTGTTTTCTACAATGTAG
GTTTAGACTGAACTCATAAAAATACATTCAGGATTCTTTGTTCTTTTTCCATATTTTTATGTGTCAACTT
TGGTAACATATTTTCTAAAAGGTTTTCCATTTTATCTGTTTTTAGATTTTATTGCTTTAAAATACAGAAA
AGAATTCTCATGCTTTAAAATCTTTACTCTATTTAGTTATGACCCATTTTATGCCTAATAGTGTTTATTT
GTGCTCTTTCTTTTTCCTTGCTCAATCTTGTCAAATATTTACCTATTTTATTAGTCTTTTTAAAGAATCA
GCCTCTATTTTGTTTCTATTCTCTATTGTTTCTGTTTTGATTCTATTGATTTGTTGTCTTTATTATTGCC
TTCCTGCTACTTTAACCATGTGTGGAAAAAGGATTTTCTTCATTGTTTTTGAGTTTACATTGTTGCCCT
TTCTCTAACTTTCTTAAAATTTTTCTTGTTTACTAATATTAAATTCAATGCTAAACATTTTCTTCAACTG
AAATTTAGGGCTTCAGTTGTTCAGTCCTAAATATGTTTTACTTTCATTTTGATTTCATATTAATAATTTA
GCAGTGTGCTTCTGAAATTTCAAAATGTACTTGGGTTTAGGGATTGTGGTTTTATCTATCTCAATTTTTT
TATTGTATTTTGGTTGAAGAATGTGGTCTGTATGATAACAGTTCTTTGAAATTTGTTATTTGTTCTGTGG
CCTGGAACCTGTTCAATTTTTATGAACATTTCATGTGCATTCTCTATTTATTGGGTAGAGAATTCTCTTC
CCATGTCATTAGCTGAAGCTTGTATAATGCCTTATTTCAATATTAAATCTTTTCCCTTTTTTAAAAAAAA
AACTTGAGCTGTCAATTTCATAGAGATGTGTACTAAAAATCTCCCACTATATGCTTCTGGCAGATCATGT
GTGTTAAGGAATCACAAATGTGGTAAATGAAACAGCATATCCAAGGCACCCATCCTTGCAGGAGGATAAA
GAAGATCCTCATGGATGTGACATTTTAGCTGAACAGGAGTAGGCCAAGAAATTCTTGCATTGCCATAGAG
GAACACCGGAGACTGGGTAATTTATAAACAAAAGAGGTTTAATTGACTTACGGTTCTGCAGGCTGTACAG
TCATGGTGCCAGAATCTGCTCAGCTTCTAGGAAAGCCACAGGGAGCTTTTACTCGTAGCAGAAGGTGAAA
TGGGTGCAGGCACATCACATAGCCAGAGAAGGAGTAAGAGAGAGGAGACGGGGAAGGTGCCAAACACTTT
GAAACAACTAGATGTCATGAGAACTCACTATCACAAAGAAGACACCAAGGGGATAGTGCTAAACCATTCA
TGAGAAATCCAGACCCATGATCCAGTCACCTCCTCCTTCAGCATTGGGGATTATATTTCAATATGAGATT
CGGGGGGACAAATACTCAAATATATCAGTTAATAACAGAGGACTTCATTCTAAATGCAAAGGCACACAAT
CACACCACCTAAATACCACTTTCCTGTATTCTATTTTCTTGCATATTTTTGACATTTTCATTGAATACCT
CAATTTTTAAAATAATAAATTGAATACATGTAAAATGATTTTCTTCTATTTTTAATGTATTAAGTTCAAT
AGAGACATAAAAATAAAATATAAATAAATAAATAAAATCTCCCACTATAATTTTGAATTGTTACT
TTCTTGTAGTTAATTCAATTTTTGCTGTAAATATTTGACACTGCGTCATGAGGCATACAAAAGGATTCTG
GTGAATATATCTTCATATTAACAAGTGATCCTCTTTATCCCTCAAATGCTTTTGGCTGTAGGCCGGGCG
TGGTGGCTCATGCCTGTAATCCCAGCACTTTGGGAGGCAGAGGCGGGCAGATCACTCAAGGTCAGGAGTT
AGAGACCATCCTCGCCAACATGGCGAAACCTTATCTCCACTAAAAATACAAAAAACCAGTTGAGCCTGGT
GGCACATGCCTGTAGTCCCAGCTACTCGAGAGGCTGAGGCACAAGAATTACTTGAGCCCGGGAGGCGGAG
GTTGCAGTAAGCGGAGATCATGCCACTGCACTCCAGCTGGGCGGCAGAACAAGATTCTGTCTCAAAAAAA
AAAAAAAATTGCTTTTGGCTGTAAAGTCTGTTTTATCAGATCCGTTCATTTATTCATTCACTGATTCAAT
TAAAATAAACATTTATTGAACATTTATTGTTTTTAAGGAATGTCCTAAACACTGGAGATACAGTAGTGAA
CAAATGAGAAAGTCCCTACTCTCTTGGATCTGAGAGATCTTATATTTTATTTGGAGATCACAGATAATAA
ACAAACAAAATATATAATTTGTCAGGTGGTATAGTGCTATAAAGAAAAATAAGGCAAGGTGAGGTAGATA
AAGTTATGCTGGGGGGTATAAAGTTATGCTGTTCTATATCATGTAGTCGTGGGCAGCTCTTGGATTAGTT
GACACTTGAGCAGAGGCCTGAAGGAGCCACCTGATGTTTATATTGCTTATATAAACTGAATGTTTGTGTC
CCACCAAAATTCATACGCAGAAGCTCCAACCTCTAATGTGATAATATTTGGAGATGAGGCCTTTGGGAAG
TAATTAAAGTTACATTCTCTACTGTGTATTCCATGCTTATTGGGTGGAGTGTTCTCTTCCCATGTCATTA
GGTCAGAACAGCAGGGCCCTCACAATGGCATTAGTGATCTTTTAAGAAAAAGAAGGAAGAGATTTTTCTT
TCTGTATGTACACCTGAGGAAAGACCATGTGAGGACACAGCAAGAAGGCGGCCATCTGTAGGCCAAAAG
AGAGGCCTCACCAGAAATGAAATCAGCCAGCACCTTGATTTTGGACTTACCAGCCTCCAGAACTGTGAGA
AGTAAACTTCTGCTGTTTAAGACACCTGGTCTGTGGCATTTTGGTATGACAGCCCAAGCTGATTTGTCTA
ATGACTATACCAAGTTCTTGTGAGCATTTCCCTATGGTATTGCTTTCTCTTCCTTTATGTTAATCCTTGT
GTTTTAGGCTTCTTTCTTGTAAAGAGCTGGAGTTTTAAAAAATCCAATCTGAGGTTTTCTGTCTTCTAAC
AGGTTAAAGTCATTTATATTTATTATGATTACTCATATATTTGGAATTCACTAGGAGCCTGAATGTTTTC
TATATACCATGCTACTTCTTTACTTGTTTTTTCTTCTTATTCTGCCTCACATTAAATTACTTGACTTTTT
CTTACACTGTTTTCCACTGATTTGTAATGTATACATTTTGTCCTATTGTTTTGACAGTTGTTACCCTCAA
```

-continued

| Sequences |
| --- |
| ACATTAAAAATTATATTTGAGAGCTGGGCGTGGTGGCTAACACCTGTAATCCCAGCACTTTGAGAGGCTG |
| AGGCAGGCAGATTGCTTGAGTCCAGGAGTTTTGAGACTAGCCTGGGCAATACGGTGAAACCACGTCTCTA |
| CCAAAAATACAAAAAATTAGCCAGGCATGGCATGCACCTGTAGTCCCAGTTCAAATTCCTTCTTACTGAA |
| GTACATCCTTGAATAGCTATTTCATTAAGGATTTGGGAATATTAAAGCATCTCAGTCTCTGACTGAAAGT |
| ATCTTTAATTCACTCTTGGTCTTGAATAATAATTTTTCTAGGTATAGAATTTTACATAGATATCTTCCCT |
| CAGCATTTGAGTATATTATTTCATTACCTTTTGATTTGTGTAATTGATAAGGTGTAGTCTGCTTCAGGCT |
| GTCATTTATTTAGAGGGTTCTCTCTCTCTCTCATATTGCTTTAAAATTTTTTTTGTTTTTATCTTTG |
| GTGATCTGCGGTTTCACCACAATCCTGCTTGGGATTCAAGACTAAGAATTCCTGACATTCACCGATTCTG |
| AAAAATTTTGTCCTAGTCTCTGAATATTTTCTCTCCTGAGTCCTCTATTTATCTATCTGAGTCCTCTTTT |
| ATATGTATATTGGACCTTGTTATTCTCTTTTTCATGTCTCTGAATGTGTTTTCAGATTTCTCATGTCTC |
| TCTTTTTTGTGTTCTATTTTTTTCTTTAACATCTCCCTACCTTTTTTATTCCTGTCCCTCCAAGGTAACC |
| AATGTTAACACTTGGTATGCATTCTTCTACATGTTTCTCCAAGCTCCTATAAACACATGCACATATATAT |
| TCATATATATCTTAAATAAGGGTGTTTTGTTACTGTTGTTTGCAAAAAAAATCCAATCATACAGCATGTA |
| TTTTTTCACAACTTGTTTTTCTCTCTTGATAGTACATGAAGGATAATCTCCAGATAAATGGATACAAATT |
| TAATTCATTTTTAAAAATAGCTAAGTAAAATTCCATGTTATGGCTATATTATAGTTTATTCAACCTTCTC |
| CCTATTAATGAGCATTCAGATTGTTTTCAGTTTTATGTCACTGATAGGGACAGGAGACAGGGAAATTCTG |
| GGCAGAAGAGGGTGGGTCCCAGTGAGGGCCCCACCCTCAAGCTGAAAAGCCTGATACCATGGTCCAAAGG |
| GAGAATTTACATCCCTGTTTTCCCACTCGAATGTTGCCTTTTCCAAAACCACCCATGGCCTGCCCTGCCT |
| CCCATCCTGAGCCCATAAAAAATCCCTGGCTCCACTGGCAGAGAGAAGAGAAGCAGCTGGATGTTGAAGA |
| CTACAGTTGGACGTTGGAGAGAAGTGGCTTGAGTTCAGAGGGACAGTTTGACGGTGTAGCTTCAGACAGG |
| AGTTTGGCCAGGGATGGCTGGACTTCAGGGGAAGATTACCTTCCATCCCCGTCCCCTTTTCAGCTCCCCT |
| TCCTACTGAAAGCCACTTTCATTGGCAGTAAAATCCTCTGTATTTACCATCTTCAGTTTGTTTGTGCGAC |
| CTCATTTCTCCTGGACGCCGGACAAGAACTTGGGTGCCACAATGCAGGTGTAAAATGCTGTGTCACACTG |
| ACCGCCCCACTGAGCTGTTAGGACTTAAGGCGTCCATGGATGGCAGGCTAAAAGAGTACTGTAACCTG |
| TCCTCTTGGGCTTCAGGGGTTGCAGGCACTGCTCCAGACGCTGCTGTGGGGCTGGTATGGAATTCGCTCC |
| TTCCAGCACCCAAAAAGCACTCACCTGGCTCCTGCATCTACTCACCTGCGTGCTCCACCTCCGTGAGGGG |
| TGGAGTGCAGCATGTCTTCATGAGTGGAGTTCACCCCTGCCAGTGCCAGAGTGGCTGGCAAGTTCCAGCG |
| CCCATGCACTCCAGTTCCCACCCATGAAGCGTTCAGGGAAATAATCCTGCTTCATCACCACAAACATTGT |
| GGCCATAAACATCCTTGTGCATATTTACTTATGTGCTGGTTCCTTAATTTCTGTGGAAGCCAATTCAATG |
| CCACTTTACTTACCCCAGTCCCTATTCTCAAAGAATATAACTTTGTATATTTTAGCTTTTCTTCTAGCA |
| TATATATGTCTCTGCATTTCTAAATAATGTATATACTGTTATCTTTTGTTTCATCAATTTTATGTATATC |
| TTAACCTTATATTATAGTAGATAAAAATTTACCTGTCTGATATGATCATATCCACAGCTTCCTCTCCCCT |
| CTTTCTCCCAGTGTAGTTATATTACAATTTGGGGGTAAATCAGCCCCTAGTGTTTTCACTATTTTGTCAA |
| AATAAATGGCATTAACAGCTAAACCTTTAACAATGAAGTTAATATCTGTCTTTTTTCATGTCCTTAATT |
| GATCTTTGTACCTGGTACAGACTTTTCCTCTATCTTCCATAGGCTCACAGTACCTTTTTCCACAAAGCTG |
| ATCACATTAGTAATCTGTCAGTTCTCCTTCTTTTCTTGGTGATTATCTGCTGGAGACCTACATTTTCCT |
| TCTAGCTAGACTTCTCTCTCGGCCTGCTAGATAGCTGACATCCTGAGATTTGTCTTCACTGTTATTCTAG |
| AACTTCCCTTTGCCTTTTCTTCTGTGTTGGATTCTCTCTCTTGTTTTACCCGATTGTTTGAGGAAGCACA |
| GCCTCCAGCAGCTATCAGAATTAAAACCTGGTGCAGTGGTAACAGCCTTCATATGCCTTGCTCTTGGTCT |
| GCTGGCCCTGTCTGGATGACTGGTCCTGTGGCTGAGCCAGTCATCATCCTGGGGTATCTCACTTCAGTGC |
| CGTCATCCCTCTGTTGTGGTCCTGTGTTAGTTCTCATAAAACTCCCTTTACACTCTCTCATTTCTGTGGC |
| TCCCAGCTTACAGTAGCCTATGGAAAATGGATCCCTGAGAGACACATTCACACTTCACATGTCTGAAATT |
| GTCTTCATTCTGTTGTGTCACATGATGACTTGTCTGTCTTGTACGGGAAAATCCAGGTTAAAAAACAGTT |
| TTCCCCAGAAGTTTGAAGATATTGCTTTATTGCACGCAATCTCCCAATGTTGCTATCAGAAAGCTGCCAC |
| TGTTCTGATTCTTGATGTTCTGTGCCTTACCTTATTTTTCCCCTGGAACCTCTGATTTTTCTGT |
| CCCCCTATATTCTAAATTTCACGATGACTGTTCTAATTGTGGGTCTGTTTTCACCTGTTGTACTCAGTGA |
| TCATTGTGGTCTTTCAATCTGTCAAGACTGTGTTCTCTCTGTAAGCTGCTCTTTCTTCCAGAACTTCTA |
| TTATTTGGGAGTTGAACTTCCTGGACAGTTTTGTGATTTTTTCATATTTTCTCACCTGTTTTCCATCTCT |
| TTATCTTTTTTCACTCTTTTTGTACAATTTCTTTAACTTCAATTTCCAACCGATCTATTGGGTTCATTTC |
| TGTTACCGTCTTAAGTTTCCTCTTTTCATCTATAAATAGTTTTTTAAGCATTCTGTTCTGTTTTCAGGAT |
| GTGTGTCATTCTTAGTTTTCTGCATTTTTTTTCTTTTCAGAAATTGTCTTTGCCTCTCCTGGTCTCT |
| GTCTCCTCCATGTTGTCTTTTTCAGTCTGTTTGTTTTGAACTCTGTCTTTCCTGTAGAGACTTTCCTTGC |
| ATGTCGGGCAGTCCTGATTGTCTGACCATATTTAAGAATGAATAACAGATGTATTGAAAGCTCTGAGGAT |
| GCGTGAGGGACTTGTCAACTCTGAGCATCACTGTAGAATAAAATGTTTCTGTCATAGGTTGGAGAACTCC |
| TAATGCTAACAACTCCTAAAGTCTCCTAATGGGAAAACCAGGGAATGGTCAGATTCTCCAGAGAACACTC |
| TTCCAGACTCCTGGCTGCAAGATGCCGCCCTGCCTGTCCCAGGCTGGGAGCTGAGATGAGGAATGAGACT |
| GGAGGGTTCAGCCTTCAGCATGCATATTTCCTTTTATTTGAGTTGGTGGCATCTCCCAATTCCAAAATCCT |
| CTCCCAGAGTTCAAACCTCCAGTATTAGCAGTTGTGATAAAGGCTGCTGCCTAGCAGGGTGGATTCAAGG |
| AAAGGATCCAGGGATCTAACTGATTCTTAAACAGTTTCCCTCACATTCTTCTTTATTTATTTTTTTTTT |
| TGAAACGGAGTCTTGCTCTGTCGCCCAGGCTGGAGTGCAGTGACGCCATCTTGGCTCACTGCAAGCTCCG |
| CCTCCCGGGTTCACACCATGCTCCTGCCTCAGCCTCCCAAGTAGCTGGGACTACAGGTGCCCGCCACCAC |
| GCCCGGCTAACTTTTTCTATTTTTAGTAGAGACGGGGTTTCACCTGTTAGCCAGGATGGTCTCAATCTCC |
| TGACCTCGTGATCCGCCCACGTTGGCCTCCCAAAGTGCTGGGATTACAGGCGTGAGCCACCACGCCCTGC |
| CCTGTTCTTCTTATTTTAGTGACTCATCTCCCTTCCGCACAGTTCCAGAGGTCACCGGTGCTATCTGTTC |
| CTGAGCCTTTGGAGGATCCACTGGTTGTTCCTAACTTTCCTGCTCCTCACTGAGGATTCAGCTTCCTTTG |
| TCTGTTAATTCTATCACTGCTTCTCCATCTGCTTTCCGTCTTCTAAAATCTTATTACTGTTATTTCTAAA |
| ATCTTGTTACTTGTTAAACCTACAACATACTAAACAATCCTGGAATTGGTTGTAAAAGGGTCATGGATTG |
| CCAGAGATCAAAAGGTATTTAAAATCCTCTCCTATTGTCCTGGTGGTTTTATGTCTTTTAAAAGGTCA |
| TCTTCCCTCGTTACAGTGACGTTTCAGGTGAAAGCCATATTAGATACAGTGTGTTCAATTCTCCATTTTT |
| GCTTGGAAGTCCTGTGTTACATTTTGGTTTAATTTTCTCAAGGCTGTCTTCCGGTTCACTGATGGCCTGT |
| TTTGTTACTCTACTGTCTAACCTTTCCATTGAGTGATTACTAGGAGTTCTACTTTATTTTTCAAATC |
| TGCTTATTCTCTTTTTTTCATGTAATCCTAATTTTCTCCCTTATGGCTTTTAGTCTTTATCACTATAATAT |
| TTTTAAACAATCTTATTTTGTACTCCATTTGAGATTGTATCTTTCCAGTTCTTAGGATTTAAAGTTTTTT |
| TTTTCCCTTTATCACTGTCCCTCATGGCAGTTTATTTGTGTGTGTTGGGGGGTGATACTGGCAGTTCA |
| ACCTCAGATATTTTTCCTTTTCTTTGTTTCTTTTTCTTTCTTTCTTTTTTCTTTTTCTTTTTTT |
| TTTTTTGAGGTGGAGTCTCACTTAGTTGCCCAGGCTGGAGTGCAGTGGTGCGATCTCGGCTCACTGAAA |
| CCTCTGCCTCCCAAGTTCAGATATTACTCCTGCCTCAGTCTCCCAGTAGCTGAGACTACAGGCATATGC |

| Sequences |
|---|
| CAGTATGCCTGGCTAATTTTTGTATTGAAATGGGATTTAGCCTTGTTGGCCAGGCTAGTTTTGAACTCCT |
| GACCTCAAGTGATCTGCCTGCCTCAGCCTCCAAAAGTGCTGGGATTACAGGCATGTGCTGCCATGCCCGG |
| CCTCTGTTTCTATAGGAATCTTGTGAGTCCTGAGTTGTGAAATCGTTTCTACATAGTGGACATATGTTTGT |
| CTTTTCTGGAGATCTAAGGACTTTCAATGATCCTAGAACTGTGTTTGTATTAATTTATTGTCATGGGATT |
| CCCCTACTCAGATACACAGGTAGTATAAATTCCGATCTTACAACTGAAAGTGGTTCATGCTTAAGGTTCT |
| GATTTCCCAAAGGTGTCCTGAGCTAGGGATACAAGGGAATGTTCTGCTCTTTATCTCTGAGGCAGTGGGC |
| AGAGTGCTTTAGTCCACCTTTTCATGGTTAGGGTGACTTTTTGAGGCTTTAGAGATTTAGGAAAGGGGCTC |
| AGTTCTGGCCCCGCTACCTCATGCAAGACCAAGGTCATGTCCCTGCATGGGCATTAGAATCTCACCACTA |
| TTCCCAGGGCTTCGGGAGCATTTGCGAGAGTCTGAAACTTCCTTGAGCACTGTGTAGTCAGCCTTACATA |
| AAAGCTCTGGCTTCAATTTTATCTTTATTTCTGGGGCCTCTGTTTCTCTCCCTTCCTCTATCCCCCTTTT |
| CCTTCCTTTTTTCCCTTTTTTTCCCCCAAACTTAACTCTGTGATATTTTCTTGGGAATTTCACATCCTTG |
| TAGTGGGAAGGGACCCATATGATTAACCTGTTGTTTGCCATTTTGCTGAAAATGAACACTCACATCTAAT |
| TTTGTGTTAAACCTGGAACATACTAAACAAACCTGGAATTGGTTGTAAAGGGTCATGGGTTGCCAGAGAT |
| CAAAAGGCATTTAAAGATCCGTTGTCCAACCCTAGCATTTTACTTAAGGAAACTGAGCCTCAACACTGAT |
| AAAACCACTTGCCCACAGACACGTGGCCAGTTAGTGGAAAAGGTGGGACTGACCTCAAAGAGTGGTCACT |
| TTTATCTCACAGCATCACAAGGAGGAACATCTGACAGCACTTGCCAGGTTATCAAGACACCAAGATCCAA |
| TGCTTGTTGAGCCTTAAGTCACTGAGACATTTTGGAAAAGCCACATATACCATTTGTGTTTGTCTTGACT |
| TGCTGTTGTGTTTTCTCTTCTTGAATACAGAGTAGTAATGCTTGTTGAATTATTTAAGTGGCTTATTGC |
| TGTGCCAGTTTGTTTGTTTTCTACCTTTATTTTTCAAAGAAAAACGCCTTTTTTTTTTCTCCTTGAA |
| GAGATCTTTCAGGATCCATCACCTACCGGAAACCTTCCCTGAAGTCTGAAGCTCTTAGAGGGTTTTTCAC |
| CTTTTCTAGCTCCTTTTGAAATTGTCATTTGAACCATGTCATTAGCACCATATGATGAATTCATCTGATC |
| CTCTTTAATTGTTGAATATGTATGTGCTTCATCTCCCCAAGATTGTAAGTGCTAGCTTGCAGAAACCATG |
| GCTTATATATCTTTACCATTTTCGAAAGTGTTTTCCTGTGGATGAGTTGATGACGAAAAACCTAGAGGAA |
| ATATGTTCTTTTAGATAGAGCCTGAGTTTGGTGTCAGGAAGCCTGGATTCTGCCCCATTTCTCTGCTCCC |
| TGGTAGACCTATGCAAACCACCGATGTTGTATGGAGAAACTACTGGTGTCTGACAATAGCACTGATACAG |
| TGGTTGTAAAATTTTTCATGCAAGCTGGGACAGTTTTCAGAGTGAAAGGGGGCAATGGTAATAATTGTGC |
| AGGGACAACAGGTATAAATTGGGACTTTCCCTAACATGCTGGGACAGACGGTCAACTTATGTTCTAGATC |
| ACCTTGAGCTCGTCAGAACTATTTGCACAGCTGCTCTTGATACCAGTCTTTCAAACAAAAAATTATCATC |
| CCTTACAAAAGTTTTCATCCACGAGCCCAACTTTACAGGTAATAAAATTTTTAGTTTTTCCAGACATTCT |
| TGTTTTTTCAGCTACTTCCATGGCTCCAAATGCGCATTATAACTGAAGTTAAACTAGATTGTAGATTTGA |
| AGATTAGTACTGCTGAGTAACAAATGCCTTCATTCTTCTTTATCAACCACTCTGTCTTCTGGAAGGAAAT |
| AAAGGCCCCGATTTCTGGAGTTCTGAGCCTACTTTTCTTGGGTGCATTTTGAAACATACGGATTTTACCG |
| CTAGTATATTCAGTGAGGAAGGAAGGCTTCTGAAGGATTGATGATCCCCAAACTGGATTATGTGTTCATG |
| ATAATGGTGTATTTGGTGGCCTAGCATAGTGAGGTGAGGTAGGTCTTTAAAATGGCTCATTATAAACATC |
| ATTGTTCCTGAGCTCACTTGCCCTTGCATCTCCTGCCAGAGTGCTTTGTACATAGTAGGCCCTCATCAAT |
| GCTTGTAGATTTTAAATTCGGAGGCACACTTGGAAGACAATGGTGGCTGGTAAATTAATTATCAGGGTTA |
| GCAACTTCATTTCTGCTTACGCTTAAAAAGTGCTGCGTGAGGAGGCTGAGACAGGAGAATTGCTTGAACC |
| AGGGAGGCAGAGGTTGCAGTGAGCTGAGATTGTGCCACTGTGTTCTACCCTGGGCGACAGAGCGAGAATC |
| CGTCTCAAAAAAAAAAAAAAAAAAAAAAAGTTCTGCTGTGGTTGATACATGGTGTTGGAATGCAAAGAAA |
| AATAGAGAAGATCCCTGCCCTCCAGAACTTTGTGACCTAGAGGCAACTTTAGAACCATAAGCCACTAAAA |
| TTTAGAAAGTTCAGGAGAAGGAACAATCACTTTTGACTTGGAGGAATGAGGTAGCACTTGAGCTAGGTTT |
| GAAAAATAAGATTTTTCTCTAGGACTGAGGTGAGAGAAGGCTGTTCCACATGGTAGGAACAGCACAAACA |
| AAAACCTGCAAGAGTAAAATTGCAAGCCATATTTGGAGAATCAGAAAAAGCCTGGTATGTTCAGAAGATA |
| AGATTTAATGATGTTGGTTTGGGGAAGTTAGAAGTCCTTTAATGTCAAATGATGGAACTCAGGTTATGTT |
| ATATAGAAAATGGAGTCACATAAAGTGTTGGATGAGTGCAGTGATATCAACCAACTCATGCTTTAGAATG |
| AGAACCTGGTTGCAGGGAGACCAGTTAAGAAGAGGCTTAGGTGTTCAGGAGAGATATAAAGGCAGGAGAA |
| GAAAAAGGAGCCAGAAATGAGATTCAGAATTGGCAGTTGATTGAAGGAAGGGCGAAGGTGGAGAGAACAA |
| CCAAACACAATCCCAAGGGACAGAGTGGATGGGGATGAGTGGAGGGGGATGAGTAGATGGGGATGAGTGG |
| AGGATGGGGATGAGTAGAGGGGGATGAGTGGAGGATGGAGATGAGTGGAGGATGGGGAGGGAGTGGAGGAT |
| GGGGATGAGTGGAGAATGGGATGAGTGGAGGATGGGGATGACTGGAGGATGGGGATGAGTGGAGGATGGG |
| ATGAGTGGATGGGATGAGTGGAGGGGATGAGTGGATGGTGGTGGAGAGACACAGAGAGGATCAGAATTT |
| GATTGGCCAAGACTCTGGATTTCCAGGGAGGTTGTGGAGAGATAAGATGAAATAGTATGTGAAAGAACTT |
| TGAACAATGCTTTGCATAAAGGAGATATTCAATGAACATTAAATTGAAAGAAAAAGGAAGGAAACGAAAG |
| AAAAAAAAGAAAGGGAAGAAGGAGCTTTTCCCCTTCTCTCTACCTCTCTGCTGTGCCCCAGTAGGGAGAGA |
| CATTGAGGGTTTTAGGAGATCTGGTGGGCATTTTTCCTGGGCTGTTCCTACCAATAGACTTGCTGCTGGT |
| TTCATGTTAGTTAGGTGGCACACCAAGAGGGGACTCAGAAAGAACAGAAGATCAGAACTTGCTGGTGTCA |
| GACAGAAAAGACATGAGCTTGAGCCACATTTGAAGAAAGAAAGAATTTGGGTTGATGAAAAGGCCATAC |
| TGAGAATTATGGGAGTAGAAGTTGTGAAGGCAAGAAGGAAGACGGAAGAAAACACACCACCGATGCAGAG |
| AAAGAGAAGGATGCTGACTGACCTTGGAGGCAGTTTCTGCATGTTCTGGGGCCTATCTTTCTATCCTTCC |
| CTCTATCCCTCCCTTCCTTCCTTTTTTCCATTCTTCTATTTTTCTGAACTCAACTCTGTGACATTTTCTT |
| GGGAATTTCACATCTTCGTAGTACAAGGAACCCATAGGACTAACCTATTGTTTGCCATTTTGCCATTTAAGT |
| GAACACTCAACGTCTAATTTTGTGTTAAACCTAGAACGTAGTAAACAAAACCTGGAATTGATTGTAAAGG |
| GTCATGGATTGCCAGAGATCAAAAGGTTTCTAAAGATCACTTTGTCTAACCTTAGCATTTTACTTAAGGA |
| AACTGAGGCTCAACACTGATAAAGCCATTTGCCCACAGACACGTGGCCAGTTAGTGGAAAAGCTGGGACT |
| GAACTCAAAGGATGGTCACTCTTATTTCACAACATCATAAGGAGGAGGCCTGTCATTTGGCGGTCAGCAC |
| TTGCCAGGTTGTCAAGACAAGATTTGATGCTTTTGGGAAATGTGGGTGAACTATTGGGGATCATTGGAAG |
| GAGAACGTTGCTTACCTTCTGACCAGCCTATCCTGAAACTCTGTAGGAAAACCCTACTACTCTATGAAA |
| ACAAACCCAGTTTCTCCTCATTTTTTTCCTGACCATTGGGAATAACAGCAAGACAGTCCTTTTAGTGATT |
| AGAAACCAAGTCACATTGACTTTTTCTGACAAGCCACTTCAGGATAACTCTCAATAATTATTTTATTGG |
| AAGTACTGGCTGGTACTTTGCCTTACAGAATGCCTTTCGGTTTCTTTGTCTTGGGCTTTGATTATTTGGT |
| AAACATTTCAGTTTCATGATGACGTGGTGTTTAGATGGCAATGCATGAATTGCATTAGTAAAATTGTTTG |
| CCTTCAGTTATATTACATCTGCTTCAGGAATGCTAGAGAACATAAACACAGTTTATTTACTAAACTACCT |
| CAGTTGGAGCATCTGAGAGAGAGAAAGCATAAAATCTGGTGGTTGGCATGGCGTCTCATCTCGAGTCAGA |
| GAATCTTGAAGCTGGGAGGTTCTTTTGGAAGCCTCCTGCTGCCGCCTTCTTCAACGTGATGCCACCATCC |
| TCCCCCTGAATGTGTCTAACAAAAGGCAGTTCTCAGAATGTGCCAACTGTTAGAAGAAGGAAAACCACAA |
| TTGAATAGAAACTTTTAAATTAATTTATCCTAACATGGATCGTAGATTTGTTATGTTGACTGCACTGCAA |
| AACGAATCAAGCCAGAATCACATTGGAATCTTTTTTTGGTGTGCAAAATCCCAGTGTTTCTTTGAGGCAG |

-continued

| Sequences |
|---|
| TGCTTTCAGTGGTGCACGTCTCTCCTGTGCAGAGGAAGGCTCTTTACATCATCTTAGCACAGTGTCTTCC |
| ACTTCTGTGGTTTCTATCACTTCTATTGCCTTTTCCCTTGGTATTGTACCTTTCCTTGATATGGGTTCCA |
| AGATGTAGCTGTACTTAAAGACTTGATGGTAAAAATAGGCCAGTCTCTAAAGCAATTACAGTTCTCTGTA |
| ATTTTTGGATCCTATCAACCAGCTTTGACATTTGGTTGAATGTGTTTTTGCAGACATCAGTGTAAACTTT |
| ACAGAGGGCCACTGAGCCTTAGCAGTTCTTCCTAAGCAAAGTTTCACTCATTCTTTTTTTTTTTTTTTTT |
| AGAAAACATTTAAGGCCTCCTATGTTCCTTTCAGTGTTCGCTGTTTCTTCTTTATCTGGGGTCCTTACTG |
| ACTCACCTTGACGTTACTGATTCATAAATGGATTTTCATTTCTTTTGCTGGGGGTCAGCACTTTGATGAT |
| TATCCACTTCCACTTCCACTGTGTTATTTTTTACATAATATTTTTGTTCTGGTTACAAAAGCAAGATAGA |
| ATTTTTGCAGAAAATCCGGAAAATAGAGAAAAGCAAACAGAAGAAAAAAAAATCACTCATAACCCACCA |
| CCAAAAACAAACAAACAAACCACAGCCCTATTGTTAATATGTTGATAGGCTCCTGTCTTTGCCTA |
| GCACTTAGAACCCTCCTAGTCAGGTTCTAAATTAACTTTACAACCTCATCTCCCTGCTTGCACCTCCTCT |
| GGGGACATACATTGCCTGGCATAAGACTTTTCATATTTCTCTCTCAATGAATTTTTTCTGATTATGTAAA |
| TAATTCATGTGGTTGTACATATTTCCAATAGTACCTATAAGGAAAATA&AGTAAAAATTATTTTTAAAAA |
| CATTTCACCTTATTAAAAAAAATCTCACCACCCTGAAATAAAAGCCATTGATATTTTGGGGACCATCTCA |
| CCACCATGTGTTTATGTCACCTCCACACACATGATTTCCCATAAATGAGATAGGAGCACCCATGCGGTTC |
| TTATCATGGACACTTGCTTTCATTTTTCACTTATTTACTTTTTCCTCTCATTCCCTTCCCTCCTTCCAC |
| TCTAATTCCTCTCTTCTAGATTGCCAGTGGCATCAGCCTTGCTCTGTGTCCTTCCATACTTTATGCTTCTA |
| CAATCTTACCAAATGTTTTGTAGTCACAAATATATGTTGTGATTGTTTTTATACAAATCAGATCATATC |
| ATATGTCCCTTTATGCATCTTTCTTTTTCTCATTTAACAGTGATAGATTGCTGAAATCCCTCTTTTGTTT |
| TTTCATGACTGCGTACTATTCCTTGATTGACTGTAGCATGAATTATTGAATGTAGCTATGACAAATAATA |
| CTGTAATAAACATTTCTGTGCTTACAGGACGTGAGATGACTTGATTAAGAAAAGAATAGATTTTTAGATT |
| GGAATAGACATTTCCAGATTGCTTTCTAAATGGCATGGTGATTCGTATTCTACCAGCAAGTCTTTCTGT |
| ATCTTGCCAAGGGACGATGCCTCTAAATTGCAAGAAAGGGTGGGATGCCTTGTCCATTTGAAATCCAAA |
| CATCAAGACAAATATGGGGCAATAATATGACCATCACAATAATATATATAAAAGAGAATTCATTAAGGGA |
| TGATTATCGCTTTCTAGAGTTGGGTTCTGGGGAAGTATTATTTATAGAAATGAGCCTTAGGAGGCCAGGC |
| ACACTGGCTCACGTCTGTAATCCCAGCATTTTGGGAGGCAGAGGCAGGTGGGTCACTTGAGGTCAGGAGT |
| TTGAGACCAGCCTGGCCAACATGGTGAAACCCCATTTACTAAAAATACAAAAATTAGCTGGGCATGGTGG |
| CACATGCCTGTAGTCCCAGCTACTTGGGGGGCTGAGGCATGAGAAACACTTGAAACCAGGAGGCGGAGGT |
| TGCAGTGAGCCAAGATCGTGCCACTCCACTCCAGCCTGGGTGACAGAGTGAGCGTATGTCTCAAAAATAG |
| ATAAATAAATAAATAAATAAAAAAGAAAAGAAATGAGCCTTAGGGCCGAAATGTAATTTTATTTT |
| TAGCATGATTTTTTTTTTATTACCCGACAGTTTTTGATTAGTGTGGCAGCTAGAAATTTCCCTCCTGGT |
| TTAATTTGCTTCTTTATAGTTTTTGTCAAAAGCTCAAATGGTACAACACATCACAGGTGACTTTTCAACA |
| TTTGAGTCAACCTTGAAAATACACAGATGGATGGATGTCAGGGTGAGACCTGACTTCAAGTTCCCATGAA |
| TGTGGTTTATATTTTAAACACTTTAAAAATAACTGTGTATGTCGTGGTGTCAGGAGTCAGGCAGGTGGAA |
| GGGTTAGGCCTTCCAGGCCATCTTCCGAGCTGCACCGGACGTTTGTCTCACCTCCCCTACAGAGATGGTG |
| GCACAGTCCAATCCCTTTTCCCTCCTCACTGGGTGTCCTCCTCCAATTCATGGATTGTCTGACACTTTCT |
| GCACTCGTCCCTGCTGCTGGTGTCTGCTGGCACTTCCTGTCCTTCTTGCTTCCCATCTTCCTTGTCTGTT |
| CTGCCCCTCTCCCTTCCATTTCTCCCGTATTTCTTAGCTTTATCACAAAAAGGCTTGGGCATCACAGCCA |
| TGGCCCACTCTTGAGATTGCATTTCTTGGCCAGCAAGCCCACCTGGCCTCATCATTTTGGCTGCAACTTC |
| AAGGTCATCAGCCCATCTTAGCTCTGTTCATCCCTAAGTTTTCTGTGGATAGGCTTTCTATTTGACAGAG |
| TGCTTCTCCCAGCCCCCTCTTAATTTCTTTATCTGACACTGTTTTTTGGGACCTAGAGGTCCCTGAGGGC |
| CTGGGGCTTCCTTGTGCGTTGAGGTGGGCCCTGTAGATTCTGCCGTCGAGAGAACTCTGACCAGCCCGCT |
| CTGAGAAAGAATGTCAAGTGGTCAGGGTCTCACCAAGCAAAGGGCCTCTATATGATAATGGTCCACAGAG |
| CTGTCAGGAGAACAAATGGGGTAATCTGGAGTGTGATTTCATCATTCTTCAGTGCATTCTCAGTGCCGGG |
| AAAAGTCATGAGTAGGGTTCTCGTTTTAACTCCTAAATTATGAACTTACTCACATTTGTGGATTAGACAA |
| TGCCTCAACATCATTTTCATAGTGTGTGTGTGTGTGTGTGTGTGTGTGTGTTTATGTGTGTGTGTGTG |
| TGTGGTTTAATGTGTACAACTCATCTGAACCCAGTTGCTCTGTGGTTTATCTTTTACTGAGAACTGCTTT |
| TTTTCTTCCTTTTCTAAGAAAATACTAGTTCTTAAAGTATGAAGTCTTTCTTGTGAGTTCATCAGCAGTG |
| AGGGGTGTGGTGTGAGGACCTACATTGGTGATAATGAGATCCAACAATCACTGAATTCAGGCGATTTTGA |
| CACAAATCATATTGACTAAAATAATATTAAGCACGTGATGCTGGTGACATTTGAATATTTGCCAGGAAGA |
| ATACCTGCATGGTAACAATTGGCTGCAAATGGAAGAGATTTGCATGTTTTATTGTTTTTACAGTTTTAAC |
| ATACATTTTTATTGGAGAATCTGAAACCAACCTATGTAGGGGAGGTTATGGGAGCAAAAGTAACACAGAG |
| AACCAGCAGGAATCGGCCTACCTGCCTGCCTCTGTCCTCCTCTGCTCCTAAGAATTTGGGTCACCTCTGG |
| CTTCAGCACTTAGTCCTAATCATGAACAACACATGAGTTAGGGGAAAGGTGTATTCACAAATTTGAAATT |
| TCTTTATGTTTTTCCTCTCTCACATTCCTTTCCTGCAGTCTCTTTCCTACTTTTTCATCCTTTGTGTAAA |
| GGTAGCAACTTTTTTTTTGTTTTTGAGACAGAGTCTCGCTCCGTTGCCCAGGCTGGAGTGCAGCAGTGT |
| GATCTCGGCTCACTGCAACCTCCGCCTTCTGGGTTCAAGTGATTCTCCTGCCTCAGCCTCCTGAGTAACT |
| GGGACTACAGGCATGTGCCACTGTGACTGGCTAATTTTTATATTTTTAGTAGAGACAGGATTTCACCAT |
| GTTGGCCAGGCTGCTCTCGAACTCCTGACCTCGTGATCCGCCCGCCTGGATCTCCCAAAGTGCTGGGATT |
| ACAGTTGTGAGCCACCGCACCCGGCCAAGGTAGCAACTTTTATTTGAGAAAGCTTGGAATCCTGACCTAA |
| GCTCCCTGAGTTCCCACTGTGGCTTGTGGCCACCTATTGTGATACTCACTCTCTACCCTTGGTTTTCTGA |
| TCTCTAAAATGAGACTGTCTACTTCACGTGGCTGTTAAATGCATCATAATTTCCTTCCTTACCTCCCTTC |
| TTTAAAGGAAACTTGGAATTTTCAAAGCTACTAAATGGAGTTTTTTTGTGTTTTTTTGTTGTTGTTGTT |
| TGTTTGTTTGTTTGAGACAGAGTCTCGCTCTGTCGCCCAGGCTGGAGTGCAGTGGCATGCTCTTGGCTCA |
| CTGCAACCTCTGCCTCCTGGGTTCAAGCAATTCTGTCTGCCTCAGCCTCCCGAGTAGCTGGGACTACAG |
| GCGCCCGCCACCACGCCCAGCTAATTTTTGTATTTTTAGTAGAGACGGGGTTTCACCATGTTGGCCAGGA |
| TGGTCTCGAACTCCTGACCTTGTGATCCACCTGCCTCAGCCTCCCAAAGTGCTGGGATTACAGGCGTGAG |
| CCACCACACCTGACCTAAATGGAGTATTTTAGGGCCACATGGTTAGGGGCAACTAAAAATGTCATATGC |
| TACCATTGCATTCATGAACACCATCCTCCCTCAGAGAAGAAAGGAGTCACATGACTGCATTTCTGGCGAA |
| ACCTGATTGCATTTTGGTAAAACCTGTGCCAGGACCAGGACAGTCATCAATGACGTGTTCCCTGATTTTC |
| ATGACTGAAGAGCTTCAGGCTGGTGCTGCCGCAGGGGACCTTTGCGTGGCATGGCTCCTCTGCACTGGCG |
| TTAGCTGTGGTGAGACACAGCTTGCAGCCACAGTAGGACAATGCCAAGTCCAATGGTATTTGCTGTTCAG |
| GAGCAAAAGAACTACACAGCAACAACACATACTATCGTCGAGTACCTATTTATTTCACTGTATGTGTCTG |
| AAGGACTAAATCGAAGCCAGAGCCCCCGCCCATGCACCAAAATAAAATGCAGACAGTGTTGAGTTACCA |
| AAATGACAGTGCACCTGCAAAGGGAAGTCAGTGAAGGTTTAAAGGTGAAGACTTAAAAATATATAGATAG |
| CTTAAAACTGCAAATAAAAAAATGTCACATAGAGATTTTCATGAGCTTAGAAAACCAGGAGGAGATTTGA |
| GTCGAGAGAAAACAAGGCCAGCCTCTCTCAAGTGGCAGATTTCTGCAGTCTTTGGAAAGATGGAAATAAA |

| Sequences |
| --- |
| TATGGCCAGGCGCGGTGGGTCACACCTGGAATCCCAGCACCTTGGGAGGCTGAGACAGGCAGGTCACTTG |
| AGGTCAGGAGTTTGAGACCAGCCTGGCCAACATAGTGAAATCCCGTCTCTACTGAAAATACAAAAATTAG |
| CTGGGTGTGGTGATGCCCACCTGTAGTCCCAGCTACTCGGGAGAATGCTGGAACCCAGGAGGTGGTGGT |
| TGCAGTGAGCCAAGATCGCACCACTGCACTCCAGCCTGGGTGACAGAGTGAGACTCTGTCTCAAAAAAA |
| AAAAAAAAAAAAAAAAAGAAATGAAAAGAAAAAGATGGGAAGAAATAAAAGCTGCAAAAGGACAAATGGA |
| CAGATTCAGGGCGGAAAGCAAGGACAGAGCAGGATTTGAGCGTGAGACTTGCTATTTGGGCTTAGGTGAA |
| ATGAAATAAAGAAAAGGGCTGGAGAAGTCAGAAGTGGGTCACAGAACAATGAGATGGTGAATGGGGTCCA |
| AAGTGTGGGTCGCCAGGACTGCCAGGAGGAGCCACATCTCCAGGGTAGGGCTAAGCTGCAAGCAACCAGC |
| ATTATTTAGCAGAGTCCTGCAGAAGTGAATGGAAAGATCTTTAAAAAACCTATGAATGGCAGTGGAAAAA |
| AAAGAACTGAAAGGAAAGCAGAAGGCTTATGGGCTAGATAAACTCATTCTCAGACATATGACTGAACTGA |
| AACTCAGATAAAATATTATCTTTTCATCCAGCGTCTTTCATTCGTTAGAAGTTCAGTTTCTTTATATTTC |
| ATTCATACAAGAGCAATGCAGATTTTTAAATTAATATATGTGCTCATAGACATGTGGATAGAAACTCATT |
| GCTGATTAGAATATTATGAATTAAGGAAATTTTAACAAAATATACTTGGAAAGTATAATATGGGATTGAA |
| ATTTGAAGCCAATGATAAGATTATAAAGACTCAGAGCTAATCTTTCATGCACTATTTTGTAAAGAATAAA |
| ATATTATTCTTCCTTGGGCCTGAAGTCCACACTAGCCCCCTCACTAAGATGATAACCACAGGGGTGAGCC |
| CTGAGATCTTCCACCCCCAAGGCCTCCACTAATCGCCATCTGGACATTTGCTTTTCGTCCCTTGTACTGC |
| CTGTTCTCCACCTGAACAGTCCAGACACTTCCAGCATGTTCACTGCCCACAAGTTTACTTAGGACCCCGA |
| AGTCCTAGAAAAAGTTGCCTTTAGCTTGGCTGCTCCTTTGGTCTGCACTGTGTCTCCTCCCCATGTCTT |
| TAGCTTCCTCAAGCTGGATGGTTTCTTCCTGACTGCACAGCTTCACTCCCAACTGTCCCTACTGCCACCC |
| TCCACCACACCAGGGGCTCTTCTTTTCCCAGGTTTTTAAGGAAACACTGTCTTTGAGGGGATCATGCACC |
| AATTTCAGCAGGTGTCTGGAGCCATAACATTTTACTTTCCTGTAGCAGTTGGAAAGATCTCTCTTTAAAC |
| ACTAGACCCTCTTGATCCTGTTAAACGGCCTGATTCTTCCTTCTGTCTTGGTGACCAGTCATCTCTGTCC |
| AACATGCCAGCTTCTCTGTCTTCCCCCACTCAGGTAAATTCAGACATTTGCCCCAGCCTAGGTCTTAGCT |
| TCCTCGCTCTGTTTCCTCTGTCTCGGAGATCTCACCTACTCTCTCTAATCCTTCCAATTTTAATGCAGGT |
| TGTTCCAAAACCCATATCTCCAGGCCTGACACGTCTCCCATTTCCATCCTGTATGTCCATGCCACCTTGG |
| AGAATCCCCCACCATTTCAAACCAAGCTCTGCCTCTCCCTCCGCCACTAACAGTGTATTGGGTACAGTGT |
| ATTGGGTTGAGGATTTATACACTTCTCCCTAGCATTGCCAGTTAGGAGACCACCTGCCAATGGGAACCAC |
| TAGTCCTGGCTCCCCACATCTTAGTCATCTTCAGTTCCATCATCCTCACTTTCTTTGTATCCGTACACAGA |
| CTAACACTTCATTTCCCCCACTTCCAACCCTGTCCTCATGGCGTTCCTAGAAATGACATAGGCGGACATC |
| TACTAAACCCTTACTTGGTCTGTATAAGTGGAGGAGTTCTAGGTGAAGGGAACAAAAGCCCAACTTGCAC |
| CCTGAAAACAGAGAGTCACGGCCCCTCGATCAATTCACACACTTGCACCAATTTACCGACCCAGAAGCCC |
| TTGAATGAAGAGGAGGCCGGGTCTCCTTGACGAAGGACCCTACCACACTGTCAAGAATTAATACTGTTGC |
| TTTTTCTCCCAGCCTTCCCCAAAGGGACCTATAGCCTTTTGCCAGGGTGACTGTGCACTGGGGAAAAGGA |
| ATTAATCAGACCTTTTGGGGACTACTGGTGACTGGCTCTGAGCTGACACTAATTCCAGGAGACCCCAAAC |
| ATCACTGTGGTCCAGCAGTCAGAGCAGTGGCACGTGGAGGTCAGGTGATCTCTGGAGTTTTCACTTCATG |
| TTTGTGTCCATCCCCATAGCACTTTGTTCAGGACAACGTGGCAGGGCCCACACTGCTGCAGTGGATTCCT |
| GGAGGCTTGTACCTCCCAACCCCCAACCCAGAGCTGCCTACAGCCACAGTATTATTCAGTCCAAAGCACC |
| TCTGTGACAATTATATTCCTGGCTCTAAACTTCCACTGGTGCCCAGTTGTTAGGAACAATGGAGCTTTCC |
| TTAGCCCGATAGTTAAAACCCTTCACAAAGTCTCCTTCCCCTTTATTTCCAGTTTTCCTGGCTATAAATC |
| CTCAACCCAATACACTGTACCCCACTCCCCCCAGCCCCCAGATACACCATCCCCCAACACGAAACACTTA |
| CCCTCTTCTCAGCTTTGCCTTTATCCACGCTGTTCCCTCTGCCTGGTATTTCCTTTTGGCTCCTTTCTCT |
| GGATTTGTGTGGTGCCTGTTTTAGCACAAATATACCATGTCCCCTTGTAAAATGTCTTTTCTTCACTTCA |
| GCTGGTAACAGCCAGGGAAATGAGCAAAAACGTGTGGATAGATTAATTCACCAGCATCGGGGAGCCGGGT |
| GGGCGGGGTGGGGGGTACAGTGTGGCGCAGGGCATGTCTTTCTGTGGGTAGGTCGTTAACAATTTTCAT |
| AAACAAAAGATTGCCTTGTTTATACCTGTTCATCAGAGTCAGCATTTCTTAAATCTGTTAAGGTGAAAG |
| TGAGTGCTTTGTGTTTTAAAAATCATATGGGAAGGACAGAAATAGGAAATGTTCACTTTGTTTAATGTGG |
| AAGTATATTCCATAACAGGTGGCCTCTCAACTTGCACAAATAAAACAAAATTGGTTGGCTAAAATCTATC |
| AGAGAAGAAGAGGAAGTAATCGCCAGGTGGTAGGACCAGGAGCAGATGGGGACTATTTACTTAGATCCTC |
| AATTCTTCTTGTTGAGTGTCCCTCTAATTAAGTACCTTTCCTTAGATGTTAAATAAACTTTCATATTTTT |
| AAATAGTATTTTTTTTAGAAAAGTGTATTCCCATGCCAGTTTCTCCTTCTTCCAAAGTCAGGGGTAGAAT |
| AACCATATAGCATTAATAGAGTCTGTGTAAGCTTAAATAGTCCAACTTTCCTTTCAGGCTTTTTATTTGA |
| AGTTTCCAAATTACACAGCTAAAATAAAAACAGCACAGAATTTAAATTGAGACCATTATATATCGCAGGG |
| ACTTCCCCCACCCCCATATTAAGTAAGGCAGTGTCAGCCCTGGTGGTCCGTGCAGACTCAGTGCACTGGA |
| GGCAGAAGTTCCAGGTGGACTGACTCCTGCCCCCACCCAGACCTCTGGTGCTCCCAGGCAGTCTGGAACA |
| ATCAGACTCTGGTGCTCCCAGGCAGTCTGGAACAATCAGACTCTGGTGCTCCCAGGCAGTCTGGAACAAT |
| CAGAGTTGCCCTTGGTCTTCCGGAAATACTGTAATTCCCTGTGCAATGTTAGCTCTTGACCATCTTTGAA |
| TTCTTTTTCTTAGACTTACAAGGCTCTGTCGCTGGTTTCCCTCTCACTCTTCTGACGACTACATTTCAAC |
| TTCCTTCAACAAACACTTATGAAGCATTTATATAGCACTTACTGACGGCCACAGCCAGGTGCAGTTTTGT |
| GGATCTGTACACAAATGAATTAGATGAGCCGGTGCCCATCGGCCCTGGGGTTCACAGACCAAGGCTCGCT |
| CTGCCGGCATCCTGGGCTCCCTCCTGCCGCCTGCACCTGGAACGCTTGGCGGTCTCCGTGCCTCTTCTCC |
| AGTTCTCCTCCACTGTGCTCCTTTGGAAAGGCTTTTCTGCTACGGCTTCAATCATAAAACTGTATTCC |
| TAGTCCTATTTCCTCATCTGAGGTGAAGCATGAAATCTCCTCTTGTTTACCCCGAATTCAGCCAGCTCAC |
| CACGAGCCCTCTCTGCATCTGTCAGCCTCTGTCAGCAGCTGTAAAAGCTTCCCTTCTCCCAGACCCCCA |
| CATCTGGAAACCGTCTTTAAGTCGTCCTCCCCTTTTTACTGTGTGTCCAGGAATCCACTTTTGGGCTTCC |
| TCTGACCGGCCTCTTCCTTCCTTCTTTTCCTCCTCCCCGCCCCACTGCCTCCACCTACTCTAGTCCCAAG |
| GCCGTGCCCCTGCCCCAACCCTCCCACTGTGCTCTTCCCACCCACACCAGAGTCCCCTTCTTTAAATCCT |
| GTCCGATCAGTGTCACTCTCATTAAGTGACAGAGATGATGTCTCCACCTTTTATATCTCCAACAGCATCT |
| AACCCAACACCTGGCACTTACTAGAGGCATCAACGATGCTTGTTGTTCTGTGTGGCGAAGGCACACCTGG |
| ATTCTGGATGGTCAGTCTCAGCTCTCCATCTTTGCTGCCTCACAGGGACTCCAAATGTGGAGCGTCTCCC |
| ACTGCCCTTAATTAGGGAAATTCAGCCTCGCAGAAGACAGTGAAACTGATGAAAGCATTGGGAAATGGAA |
| CCTAGGAAAGTTAAAGAATTGGCATCATTTGATGTGAGAAAGAGAAGTGAAGATGAGAAGAATCTAGG |
| GAAAAGGCTACATGCCCTGTCTTTCTTGAGACAAGCGTGTGCACTTCCTTTGCTTCCACTCTTACTTGTG |
| TTTATCCTTGGAGGGACCTTTAATTATCTAACGCTTGGGTATTGGCCACGGTGCTTATCGTCTGCGTGTG |
| AATCTGGACATGGTCCCCAAGCTGTGTGGTGCTGTTTGTTGGTGCGGTCCAGGATGCACAGGGCTGAGAT |
| GGTGCTGCATGCACACTTACCGAGCACATCCCCCTGGGAGAGGTGTGGACACCACCGTGAAGGGGCCCA |
| GACCTCCTCCTTAAATGCCTGCACTTTCACGGGATCAGACATGGAGACAAGAACTCTCAGAAGAGGGAG |
| AGGCCTGAGGCACAGCAGGAAGGTACAAGTTCAAAGGAAGTGAAGATTTCCAGTGAGAGCTATCAGACTC |

| Sequences |
|---|
| TTGAAATGGACTACAGGGAAAGCCTGTGGTCTCCTCTTTCTTAGAAATGCTAAACTCATAACAGAAAACC |
| TCTCCACCGTGGCTTGAGTGTCAAATTCTCTGGAGGCCTGGGGATGGGGCCGGGAGTTTTCTGCCTCTAT |
| ATCCCCATGGTCCACTTATTCGGGTGGCTTAGTTTGCTTTGCAAGCAGGGGGTGGGAGCGGGGCTGCTTA |
| TTCCAACCACAGTAGTCAAATGTGTTACTTATGAGAAATAATAAAAGATCCTTCTTCTTTTCTTTTTCTA |
| GACCCCCTCTAGTCAAATGTTGTTGTTTTTTTAAATAGAGGAGGTTGTTTTGCATTTTTCTTTTCGTAGT |
| GTTCGAATTTAGCTTTTGTATATACTCTCCCCAGTAGTTCAGAGTACATTCATGAGCCCAGATCATGAGG |
| AATGCTCACCATTTTCCTGAAAGATGGTGTGTGGAGGATGTGTACAGATAGAAGCTAGGCTGTTGAAGAT |
| TTTATTGAACTCATCAGCATTAACAACAGACACTGTTAGTGAGGTCCGAATGTTTTTGTTTATTTTTTG |
| ACTCAACAAACAGTTATTGAGCAAGGCTTTCTTCTGTGCCCGGCAAGATGCTTGCCACTTGCTGAAGAGA |
| CAAAGATGCATGAGATATGGTCCCTGCTTTTAAAGCACTTACAATCTAGCAGGGAAGACAGCCAGGTGTA |
| CAAATAATCATATGTGTTACAAAGAAACGATTATTCCGGTTCAAAGGAAGGCTGTTGTTGATGAAGGATG |
| GTTGCATAGCAGAATTATAATCGTCAGTTTGAAATTCAACTTTTTCAAGCTTTGTCATTTCTATCTTGTA |
| TTAGCCTTATTTTTCCCTTTTTCAAAATACTTATTTGCATAGGTATTAGTCACATGGTTCCTATACTGGA |
| ACAGTTTAGAAAGGTGTTTATTGGAAAGTCTCGCTAGCACCTCCGTCCCCATCCACCCAATTCACTACTC |
| GCTCTTCCATCAGAATAAGGAACCATTGTCTATTAATTTCTTGAGTATATATCCAGCGCCCATCCATGCA |
| AAATAACATATACACATTTTAAAATTTTCCCTTTCTTACACAAAAGGCAGCTTACTGTTTGCCCTGTTAA |
| TTTAACAGTATATCTTGAGATTTTAGCATGTAAGATCTTATCATGGTACATCTTGAGATGTACCATGTCA |
| GTACATAGAATGCATGCTTTTCCTTTCTTCCTAGGTAGTATAATACTTCCTAGTATTGCATCGTTTTGGA |
| GATATCAGAGTGTGCCAGTTATCAATTAGCTGCATAACAGATTACTCCATAACATAGTGGTTTAAAACAA |
| CAACCCTTTTATTAGTCATAATTCTATGGGTGAACTATTTGGCCTGAGATCTGCCAAGGGTTTTTTACTG |
| CTGCTTTTGCCTGGATTTGTTCATATGGATGTGATTATTTGGGGCTAGATGGTCTAAGATGGCCTCACTA |
| GCAGGTTGTTGGGAGAGTCTGACCTCAGTTGGAATATGTGCCTTGAGTAAACCAGCCCCAGCTGCTTCAT |
| ATGGCGACTGGGTCCCACAAAAACAGAGAGGGGTTGGCCCCGCTGTGGAGGTTTTATTAAGCTTCTACTT |
| GAATCCCATTGGTTAATGTTCATTGGCAAAAGCAGGTCATGGGGCCAAGCCCAGAGTCAATGTGGAAGC |
| AATTTCAGGATGAGAAATTCATTAGATGTCATTATGTAACTATTTACTACCCATGGAGTAATTAACCAGC |
| CCCTGATGATGGACACCTGTTTATTTCCAGTCTTTTGGTATTGCAGATAATGCTCCAATAGATAATCTTG |
| TATATTAGTCAGTTCATATGTGAGCAGGGTAAGTACCAGAAGTAGTACTGACCCTGTGCTGGATAGAGGG |
| CAGATGCCTTCTCAATTATCTATCTATCCTATTTCTGTGGTGCTGTTTCTCTAGATATTTTAAGCTTGTG |
| TTTTTCTGTCACTCGTGCAGGAGCTTTGAAAATGTGAAAAGACTTTAGATAGGAAATGCATATAAACTGA |
| ATTAATTAGAAACTCACTCCTAAAATAACAAAAAACATGAAAGCTAGAATAGAAATCAAATAATTTTGAG |
| TAAAGTAATGTGTACATTATTTGAAGAAATACAAGTATGTCTGTTATAACAATACTTTACATTTCTGTTG |
| TGTTTACAGCATAGAAACACTTAGTTTGCTTTTAGTATCTCAATTCTCAATAACAATTCTATGAGTTGAAA |
| GTATAATTGGCCCCATTATGTGTGTGTATGTGTGTGTGTGCGTGTGCATATGTATGAATGTATTTA |
| AAGGCTTAGAGAAGTTACCTAACTTGCCCCAACTAACAAGTAATAGCCAGAATATATACCCAGCCCTGTG |
| ACAATAAACTTGACGTTGTCCCATTAATCGCATCTTACTAGTAGGGACTTGTATCTTGTATCTGGCTTAG |
| CTTCTAAAGATATACATGTGCTCAACTTGCTAATTGCTTTGCTAATCACAATCATATATGATATC |
| ACCTCAGGAGGCTCTTTTTAAAAATATATAAGTAGTTAATTTCTAATTTCTGAATAGGTGGGGAACCTCC |
| CTGAAGTTTTCTCTTGTTTTACACATGTCATTGGCATCCAGGTTGAGAGCTCCATCTCCTGATCATAGCC |
| TCTAGTAAATCTTGACGGAGGAATTCTCTTTAAGCCCAGGGTCTTGCTTTCAGACTTCAGAAAAGAGGAG |
| TTTTTTTAAATAAAACCTTGTCTGGCCCTCCCGCAATGGATGCAGAAGGTAGACTGTTTTCTTTCTTTTA |
| ATTCACACTCAGACGTTTTCGTAAGGGGCTTGGTCCTGGCAAAGTGGGCCTCACATACAAACCACCCACT |
| TTCCTGAAGCGTGATTGATTAGCAAAGCTGTTCTGCTCAAGGGCAGCCTGTTTTCCCCAGCCTGGATGCT |
| GACAGGTCCGACATGCACAGATTTTCAAGCAGGTCGCCAGTCCCCAGGCTGCAGGCTGTAGGCCAGGACG |
| CTTGTTCTTGAGGGAGAAGAGAGGAGAAGAAATCCACTCCGGGGCAAGAATTAAGCTATATTATAGAAT |
| TCCCAAGACACAGCAGGGCAGGCCAACATAGTCCTTGTTTAGGAGCCCCTGATGGTGTTGGGTGCCAAG |
| AAAACCATGGCTGCACAAGACACACAGAGTGAAGGTGAATATAAAGATGTTTAGGCAAAGCCTGTGCATA |
| TGGTACTGATCCCCATTTGTCTAAGAACCTCTAAACATCAAAGAGAGTTAAAGAAAGATAGAAATTTGAT |
| GCCTAATCAAAGTAGCCTATGATGGAAGTTTGGAAATACAGCCAAGCAATAATACTGTAAACAGAACGAG |
| GTACAGATCATGTCTTTGCATGTTTGTCTCTGTGGCATCTAACAGCGTGTCTTTTACAAGTAGAATCTGC |
| ATAAATATATAGTCACAAAATGTTAGAGCTGAAAATTATCTTACAAACCGTCTTGTCCAGGCCTCACCAT |
| TTTAGGAATGAGTTAACAGAGGTACAGACAGGTTAGGTAAGTGGCCTCAGTTGTTCTGAGTCAGACCAGG |
| TCTTCTAAATCTTAGTGAAGTAGTTGTCATAAAATTGTGCTGCCAGTATTCTAACAAATGTTATGTGAAT |
| GTAGGAATATTTTATTTTTTTTGAGACTGAGTCTTGCTCTGTCGCCCAGGCTGGAGTGCAGTGGCCCGAT |
| CTCGTCTCACTGCAACCTCCGCCTCCTGAGTTCAAGTGATTCTCCTGCCTCAGGCACCCAAGTACCTGGG |
| ATTACAGGCATGCACCACCATGCCTGGCTAATTTTTGTATTTTTAGTAGAGACAGGGTTTCACCATGTTC |
| GCCAGGCTGGTCAGAAACTCCTGACCTCAAGTGATCCGCCTGCTTCGGCCTCTCCAAGTGCTGGGATTAC |
| AGGCATGAGACACTGTGCCCAGCCAAAGGAATACATTTATTTCCTTTTTTTCATTGTAGAATTTATTATT |
| ATTATTATACTTTAATTTCTGGGGTACATGTGCAGAACGTGCAGGCTTCTTACATAGGTATACACGTGCC |
| ATGGTGGTTTGCTGCACTCATCACCCTGTCACATACATTAGGTATTTCTCCTAATGCTATCCCTCCCCTA |
| GACCCCCACCCCCTAACAGGCCCCAGTGTGTGATGTTCTCCTCCCTAGGTTCATGTTGTTCTCATTGTTC |
| AACTCCTACTTACGAGTGAGAACATGTGGTGTTAGGTTTTCTGTTCTTGTGATAGTTTGCTGAGAATGAT |
| GGTTTCCAGTTTTCATTCATGTTCCTGCAAAGGACATGAACTCATCCTTTTTTAGAGCTGCATAGTATTCC |
| ATGGTGTATATGTGCCACAGTTTCTTTATCCAGTCTATTATTGATGGACATTTGGGTTGGTTCCAAGTCG |
| TCGCTATTGTGAATAGTGCCACAACAAACATACATGTGCATAAATCCTTCTACTATGAAGACACATTTAT |
| TTCCTTTTTAAAGAGATTTATTTAAGAGTCACTGATTCCGTAAAATCATGGAAAGTCATCTCCTTAATTT |
| ACTTATGTATTAACAAAGGAGATTCCCCCAAGGTACTTTCTATTAGGGGCGGTGGGAAAAGGGAGGGTT |
| ATAAGGATGAATTGACTAGCGTCTTTTGAAAGACTTTCAGGAATTTGGGTCTTAAGACATTTTGGCCATC |
| TTACAGAAAGTCTTAAATGTCAGAATTGGGTGAAAAAAATTTAACTTTTCTCACAATGGTTTGTTATATG |
| CTCAAGGTCAGATAGCTTGGTAGGGACAATTCAGCCTGCGGTTAAGAGTGGTCTCTATGTGTACGTCAG |
| TAAACTGGCTATCAGCGTAGCAGCAGGAGCAGAAATCATCAAGACCGTGGACCCCCCAGCCTGTCACTTG |
| ACTTCTGCTCCGTAATGCTGCCTGCACATTGCCCATTTGGTGCAGGTTATGCCTGGCTTGTTTCAAACAT |
| CCCGTGCCTGCTGGAGCTGAGGATGCAGCGGATTCATTAGCTCCATAGGAATGGACCCCTTCATTCAAAG |
| CTCAATTTGGCCCAGGCGCAGTGGCTCATGCCTGTATCTCAGCACTTTGGAAGGCTGAGGTGGGAGGATC |
| ACTTGAGCCCAGGAGTTCAAGACCAGCCTAGGCAACCTAGCGAGACCCCATCTCTATAAAAATATTAAAA |
| AATTAACCAGGCGTGTCCCAGCTATTTGGGAAACTGAGGTGGGAGAATCACTTTTTCCCAGGAGTTGATG |
| AGTTTTCTCCCACCCGTGTTGAGCTATGTTGCACCATTGCACTCCAGCCTGAGTGATAGAGCAAGACCCT |
| GGCTCTAAAAGAAAACAAAACAAAAAATAAAGCTTGATTTGTTTTCCCATCCCATGGCCCACTGCCAACT |

-continued

Sequences

CTATCATTTTTGGCTCTTGACTGTCTTATACGCGGGAGTGTAGGGAGAAACTTTTGCCAGTCCCTTCAAA
GATGGCTTTGACAATCTGTTGTCCTGAATAAATTTGAACACCTGACAAAAGAGTGTCTAGAATCTTCCTT
TCCTTTACAAAGTGTAAGGGGTCAGATGTATTGCCCCTTTTGGGATATAAATCAGTTATTGTTCTGCCAG
CCACTGGGAACATTTTAGAAGCCCATTTATTACTATCTGCAATGGTACCTCATATTTGGTTTCCTGTGTC
ATAAAGAAAAACCTGCAAATACCTAAAAGTAAGGATTCCAGTGAAATGTGGGTTCTGCTTCACTCTGTTT
GGTGTGGGAGGCTGTGTAAGTCTAACTCTAAGAATACCGGTAGTGGTATCTATCTTCATTCTAAGAACTG
AGGGAGGCGAGGTTTGTGCAGAATTAAATCACCCTGTCATATCTGTGAGGGCTTCCTGCAGAACGAAGGC
AAGTAAACCCAAACAAACAAAACAGGAACATGTTGGAAACAGTCAGAGGTATACGTCTGGAACTAAGGTT
ACGAGCTGAGCCTTGAAAAGTTCATGAGAGACTGGCTTGCTTGAAAATATCCTTCGTGTGTGTGTGTGTG
CGTGTGTGTGTGCATGTGTGCGCGTTGTTTTGTTTGTTACGGTTTTGGTCCGTGCTACCGTATTTACC
CCATGTGTGGTGGTTGGAAATGTCAGGGTTTCTTGATTGAAAAAGGAAATAAGAGATTATGCCACTCACA
GCACAGAAGTGGGATGAGCCTCACTATGGTGTATACGTGTGCGTCTGTGTGTTTATGTCTGTGTCATCTC
CATGTGTTTCTGTGCCAGTGTCTGTGTGTCTGTGCATATGTAGTGTGTCTGCGTGTCTGTACCTGTGTGT
ATGTCTGTGTACATGTGTCTGCGTGTATGTGTGTGTCTCTGTGTATGTGTCTGTGCATGTGTTGTATGTG
TGTCTATGTTGTGTCTGTATCTGTGTGTGTGTTGTGTGGTATCTGTGTGTGTGGGTCTGTGCATGTGTCT
GTGTGTTGTGTGTGTCTCTGTGTCTGTGTATGCATGTGTCTCTGTGTGTTGTCTATGTGCATTTGTCT
GCGTGTGTCTCTGTGTATGTGCCTATGTTGTGTAGTGTTTGTATGTTTATGGCTGTGTGTTGTGTGTG
TCTATGCATGTCTGTGTGTGTTGTGTGTGTCTCTGTGTCTGTGTGCCTGTGTGTCTTGTGTGTGCATGTT
GTGTAGTATATGTGTGTGTCTCTGTGTCTGTGCATGTGTCTGTGTGTGTTGTGTGTGTGCATTTGTCTGT
GTGTTTCTGTGTGCATGTGTTGTGTAGTGTGTGTGTTGTGTGTGTTGTGCGTGTCTGTGTCTGT
GTGTCTATGTGATGTGTGTGGTGTGTGTCTGCGTCTCTGTGTCTGTGCCTGTACATGGGTCTGTGTGT
GTGTTGTGTGTGCATTTGTGTGTCTCTATGTGCATGTGTTGTGTAGTGTGTGTGTCTTTGTATGT
CTGTGTCTGTATGTCAGTGTGTGTCTGTGTGTGTCTGTGTATGTCTGTGGGTGTCTCTGTGTCTGTGTGT
CAGTGTGTGTCTGTGTGTGTCTCTGTGTCAGTGTGTGTCTCTGTGTCTGTGTGTGTCTGTATATGTCTGT
GTGTGTGTCTCTGTGTCTGTGTGTCACTGTGTGTCTTTGTGTGTGTCTCTGTGTCTATGTGTGTCTGTGT
ATGTCTGTGTGTCTGTGTGTCTCTGTGTCAGTGTGTGTCTGTGTCTCTGTGTCTGTGTGTCTCTGTGTCA
GTGTGTGTCTGTGTGTGTCCCTGTGTCTGTGTGTGTCTGTGTGTGTGTGTCTCTGTGTGTCAGTGTGTGT
GTCTGTCTGTTGTGTCTTTGTGTCTGTGTGTGTCTGTGTATGTCTGTGTGTGTGTCTCTGTGTCTGTG
TGTCAGTGTGTGTCTGTGTGTGTGTCTCTGTGTCTATGTGTCTGTGTGTCAATGTGTGTCTGTGTCTATG
TGTGTCTGTGTGTCAATGTGTCTGTGTCTATGTGTGTCTGTGTGTCAATGTGTCTGTGTGTGTCTC
TGTCAGTGTGTGTCTGTGTGTGTCTCTGTGTCTGTGTGTCAGTGTGTGTCTGTGTGTGTCTCTGTGTCTA
TGTGTCTCTGTGTCAATGGGTGTCTGTGTGTCTATGTCAGTGTGTGTCTGTGTGTGTCTCTGTGTC
TGTGTGTGTCTCTGTGTCTGTGTCAGTGTGTCTGTGTGTGTCTCTGTGTCTATGTGTCTCTGTG
TCAGTGTGTCTGTGTGTGTGTCTCTATGTCAGTGTGTCTGTGTGTGTTTGTGTGTCTGTGTGTG
TCTCTGTGTGTGTGTGTGTATGTCTGTGTGTGTGTCTCTACATCTTTGCGTATACAGGGGCATA
GCATAGTCATGCAAAACCGTCTTCCTTCAACTCATAGTTCTCTCCTTCCTCAACAGAAGCCACTCTGCT
TTGTTGTGAAAACAAATAAACTACTTTCTTACAAAAGAAAGACCAAATAACCTGAAAAGCTCAAATAAAA
TCCACCTTATGATACAATATTAAGAAACAGAATTTTCAATGGAGAAAATCCCACACCAGACTGAGGAAG
ACAGATCAGTTTAACTGGAGTCTCTGTTTGTTTTATATTTCTTTTCTACTCTCCACTCCCATTTGCCAAC
AAAACTATGCTCTCTCACAGGGGACAGGTTCACCCCTCAATGTCTGACTAACATGCTTTTCATTTGAATT
CAAAATATTTGGTGACGATTGGCAAAGAATGAGGATGGGAAATTGAATATTACATCATCTTATGAAAGCT
TCCTCCTCCCTCACTTCCTTCTTCCTTTCTTCCTCCTTTCTCTCCCTTTTTCCCTCCCTCCTTTCCTCTC
TCCCTTCCCTTTTCTGTTCCTGCTGTGACCGTTCCCCTGATTGAGCAGACGTGGACATGGGGAGTCAAC
TGTAGGAGTGACTGGCGCCTCACAGACACCGTCCTCTGAGGTAGCTGTCACCAGAGGATTGTCACTGAAA
ATGCAAGAAGAGTTTGGCATTTGATTGCATTCTGCACAATTCAAGCAGGACAAATTGCTGCAGAAGATGA
CACCAGAAATAGCCACCATGTAGTGGGTTCTCACCACATGACAGACACGGTGCTGCTATAAGCTTGTGAC
TTGCACTGTCTGAGCCCTGAACACCTGTAGCAGGTACGAGCATTTGCTTCATTTTCAGACCAGGAGACAG
CAGCTCAAAGAAAGTGAACGATTTGTCAGTGGTCACACAGCTAGGAAGTGGCAGGGGCGCTTAGCCGGG
TTGGACTCTGAAGGTCATGCAGCATCTTTACACAGACCCAAACCCTTCAAATCGATTTCCACCCATGTGT
GTTTGGCAGCCACATGTCAACAAGCCATAACTTTCTTACCTATTTCGGGAAAACATTATTTTCTCTCACC
TGTATTTATCGTCATCCTATTTCTGTTGCAAGAAATCAAAACGTGAAGAAGATAGATTTGAAGAAGACCT
TTTTTTGGCTACTTCTGATGATGAGATGCAGTTAGGAAGATGGAGTTCAGATGCTAAAATATTGGAATTT
CTGATTGATGCATATTCATGGTTAGAGGGAAAGTAAGTTGCACTGTGGAGTTAAGAAATCTGAGAAATAC
AGGAAATCCAAGCTGAGAAAAACTCATAACTATGATGTTTCCATGTGCAGGAAACTTCAGGTCCTTCTGC
GCCCAACCTTCCTGGAAAGCTTTTATTTAAAAAAGTTTTTAAAATTTTTATTTAGTTATTTTTAATTGAC
AAACAAAAATTGTATATAAAGGCTTTTGTATTTTATCCCGTATGATAAAGGGCCGCACGGTTCTTTCTTG
ATGCCTGAGTTAAGTGAGCATATTAACAGCATGCAGCGTTCAGCTCTCATTAATTTTCAATAGGCTCATT
TACCTTTGACCCTTTTATTTCAAAGCCAAAAAAAAGACCATACATAGAGAGAAACGATTGCATTATAGCT
CCTCCTTCAATATGAGTCGCTCAATCTCTAATGGTTTCTTTCCATCGAGAAGAAGGTTTTAGTAACCAAG
TGACTAAGTTACCTAGCTAAACTCCCCCCTCCTTCTTTATCAATACTTAATTAGTATTGATGCTTTTCTT
GGCTAAATCTCATTTCAGAGCCTGCACAACTGAACTTTTCCATAAATGAACCTTTTAAAATGTGTATTT
GAAATATCTTTCAGCCTAAGAAAATAGTTTTTAACAAGTTATGCATTGATTTCCTCTTACTCTGAAATAT
TTCTCAAGTGATTTTTCCTGAAAGATTCTTTGTGGTTCATTGAACACAAAAAACAAACCGTGTACCAGGT
CTGGTAGAGGTTACAGGGATACAGATAACTTGGCATTTGTTCCCAAGGAGCTTAGGTCTCCAAGAGGAAA
TAAGACACTTCGACAAATAGCCACAAGGTAAAATAGAGAATTGTCCAGTGCTGTAATTTAACTGCTGATT
CCGCTGTACCTAAAAGCTGGTTAAATTATAGTTTTATTGAATGCTAACAAACTCTTATTCCCCTCCTGCA
TGGAATTTTAAAAACCTTTTATTTTCTCTGGGCTATAATTATGGTGACCACATTTTCCATGGCAAAAATT
AAGACACGTCGTCTGACAAAGGATTCTTGTGCCACTTCTAGGTGTGAGACCACCCATACTTAGATTTTTT
TTAAAGCAGGCTTTTTAGGCAGGCCCTATAAAAATAGAGGTTTGTTAAATAGGTGTGTTTTTAGACTTTT
TCATTAAAGCCTACAATACAAACAGTATTTTATTTTGTATCTGAATCAACATGTTATATCCTAAAGCAC
TATTTTACAGCCTAAGGGTGTGTGTTAGTCTATTCATAAAAACATACTGCTGCATAGAGCAATAATACTT
GCCATTATCTAGGTGTAATAAAAAGGTCCCAAGTGGTCCTCTCCAGGTCTTTAATTTTCCTTTTGAAGAT
AAAGCTCCTTCTTTCACTTTCATGGTTCAAGATTTTTGGACCTTGCAAGTGATTGCTATTGAAGTGTGCC
AGATGTGAGCAGTTGTGAGCATAGTACTTTAAAAGAAGGTGAAGGAGTGACTTTTTCTTCCTTATTGTCT
CCCCTACTACCATCTGTAGTTTCTACACATGTAACTTTTCCAAAACAGCAAGGCATGGGAAGGGATACCA
GCCAGGGCCGCCACAGTCCAGGCATGGGACTTCTGAAGTGAGGAGATAGAGATGAAAGCGGCCTGTATTG
ATAAATGACAGATGATGAAACCAAGGCCTGCTGGACCAAGATTCAATGACTTACCCAAAGCTACACAGCT

Sequences

```
TGTTGGTGGCAGAGTTAGCTCCCAATCCCCAGCTTTGTGAGCAAGGGAGGTTTCCATCCCCACTATGATG
TTTTCTTGGTGTTCTGGGGTCACTCTGGTCGATTTCCATCCACTGTGATGTTGGGTATGCCCCCTCCATG
TGACTACATAATTCTAGAATCATAATTCTAAAATGATATATCACTGCACTATCATGGGAAAATAAGCTGG
AAGAGCTGGAGAGGCGATGCCTGCCACCACTGGCTCTTCTATAGAGGTGACCTTGCAGGTTACCAGGACT
TCCCCAGGCCGACTCTCAGATCCTGAAGCTGAGTCCAAGGCAAGCCTTATACGCCATGGTTCCTGCTCTC
CTGGGTATCACTGACCTACTGCTGATCCAGGAACCCTTGGGATCAGACTTTTCCCATTAATGCTTTGTTT
ATGGTTAAAATATCACAGAGTTTAGTGGGACCACTGCTGTCTTTATTAGATGGTTTTTATACTTAATTAT
TTTGTAACATGGCTGCACTTGTAAGTTATCTGCTGATTTTTTTGTAGTTCATAAGCATAATGATTGGGTA
TTCATAGTCATATGTGAGATGTGCCAACCTCAATCTCTATGCTACAGTATAGAGTATACTATAATAATCA
CTATATTATTACAGCCTGGCCAACATGGTGAAATCCCGTCTCTACTAAAAATACAAAAATTAGCTGGGCG
TGGTAGCGCACGCCTGTAATCCCAGCTACTAGGGAGACTGAGGCAGGAGAATTGCTTGAATCCTGTGGGG
CAGAGGTTGCAGTGAGCCGAGATCATGCCACTGCACTCCAGCCTGGACAATAGAGTGAGACTCCATCTCA
AAAAAAAAAAAGAAAAAGTTTAAAAATGTATCTCTTCCATTAAAAACATATCCAATAATTCTGCTAAG
ATATTTGACTGACCTTCACATTCAGCCTCATTCCAGTGTAACTTCCCATTCATTCATTTCATTCAATGGC
TATTTATTGAGCACCTACTATCTGGCAGACACTTTTCTGCTTCAGCATCAAACAAATAGACAAAAATTCC
AGCCTGTTTGTGGTTTATATGGGATTGGATGGTGCTAATAACTGTATCGAAAAATAAAAACTATTAGCTT
GCCAAAAATTTGGATTACTGTGGGAGCAGAGAGCTAAAGGAAAAGGGAACTCATATGTATTGAATATCAG
TGACTATGTCATATGCTGTGTTGTGTGGTTTATCTCATTTAATCATCACAGCAGCCCTGTGAAAGATGAA
TATGATTATTTTTATTTTTTACAGATGAAGAACCAAGATTTAGGAATATAATATATCTTGCTTAAGGTCA
TACTAGTGAGGAAATAAATCTACATCAGTCTTTTCAATACCATGCTAGATGTGATGATATCATTTTAGAA
CCATATGTTTGATATATGGACCACCATACTGAAACCTCAGGGCACATTTTTGTCCACTAATAATATATAT
CAAGGAATGTCATTTCACAGATGCATGGATACGGAAAATGTGTGTGTGTGTATATATATGTATGTGTA
TATATATGTGTGTGTATTTGTATGTGTGTGTGTATACACACACACACACACACACACACACACATA
CATACTACTCCGCCTTAAGAATATTTTCATATGCAACTACATGGATGATTCTTGAGGACATCATGCTCAG
TGAAATAAACCAGTCACAGAAGGACAAATACTGCATGATTCCACTTATATGAGCATCTACAGTAGCCAAA
TTCACAGAAGCCGAGAACACAGTGGTGGTTGTCAGGGCCTAGGGGAAGAGAGAAATGGGGAGTTGCCCTT
CAACAGGAATAAAGAATAAGCAAATCTCATGTTAAGAGTTCTTAACACACACACTCACACACAGACACAC
ACAAATGTCACTTTAATGGACATGTTTAAAACATCATTTGAAATGTAGTTGTTAAGTTCATGTTCTCCTT
ATCATTTTTGTAGATTGATCCTCATTTCTGAATAGCAGTAATCACTACAGTACACTCTCCTTTCATAACA
GGCATCTTCCATGGAATACCTTGCCCCAGATTAGCAATTTGATGACCACAGTAACATGTGCTTCTCAGAT
AACACATGACCTTTCATTTGGCTGAGAACTCAGCGGTTGACTTTGCTAAAAATAGGTCTTTAATGGTTGA
GTGTGACATTTCATCACGGGGTGTTATTTGGGAGTTTTTCTCTTCATACATGAAACAAGTATGGCTGTAG
AATTGATTACCCTTGTTTCCTTGATGAAACGCATTCAGAATTTCAAAGATATTGAAAATATTTTTGGCCA
AAATTAGTTACACAGAAGTATGGAATCTGTCAGTGCTTGGGGACAAAACCCTTCTGTGTATTGAAAATGC
AGAAGTAGACAGGGAAGCATTTCTGGGGAGGAGTGAGAAGCTGTATTAAGTCTGGATGCTGGGGCAGGGG
TGAAGGAGGAGGTCTTGATGATGTAGGTCTTGACCAGGTTGGAGCTGATGCAATGGCAAGTGCTGTGGCC
GTGGTATCCCCTGGTGATGTCATTCCAAGGAGCCAGCTGCCATCAGTGCTTTCAAGAGTCTGGCTCTTTG
GGTGAGGGGCACCAAGGGATAGACGTGCACCTCAGGACACCTGCCATCTTGTTGGCCATCTCTCTAGTTT
GGGGTCTTTGTGGAAAAGATGTATGGGCCATGCTTTTTAGCTTGTCTTATCACCCCAAATACTTCCCGTC
ATCCTAGAATAATATCCAGGCTCTCGATCTGATTTCCAAAATCTTACACTGCCTTCGCACTCGATTCTCAA
GCCTCAGCTCTCCACCAACTGCACACTCCCCCATTGCTTGTGGGCCACTCGAACTGACTTCCTGATCCTCC
AAACACATCAGGTTGCTCCCTCCTTGGGATCTTCCACTACTTGTGACTTCTGCCTACATTGTACTGCCCC
TAACTTTCCCAGGGCTGGCTCCTTCTTGCCTTTCAAATCTCAGCTTAAATGTCACTTCCTTTGAGAGGCT
CCCCTGGAACACCCAATCATTCCCTCTCCTATCACCCTACTTTAATTCTCTGAATATTTCTATACAGTCA
ATGCTGTGCTTGTTTATTCTTTGAGATCCATGAAAGCAGGGACCATGCTGTCATGATTCCCGACAGTGCT
CCCAAGCCCTAGGTGAGCACCCTGCACATAGTAGTTCAATGAGTAGTTTGTCAAATGAAGGAAGGAGGCA
CTCAGGCTGTAGATGATTTAAATGTAACAAACGTATTTGTAGGTTATTTTTTAATAATGCAAAAGAAATG
AAGACTAGGCCAATTTTCTTTTTTAATTTCATATTTCAGCCTCAACGCTTAGTTATTTCTGATTGGTCAG
AGATTAATTAATCACATGCAACAGTCTGTCCTGAGGGGGTTCAAATGCACTGCTTTTTCCAGTGATTTGC
AAATGCACCGGCCTAAAACCTACTCTCTGGCACAGATTTCAGAATCTCCACTTAACACATCAGAAACCTT
TAGGGCTTATCCTGAACTCCAAGGCTGGCTTAACTTCTTCAGTAAGCAGCTGCTTATGCATGGATGCCTA
CAATGAGTGATTTCACCAGAAACCCACCTCAGCTACTTAAAGTGTGATGTATTTCATACACACAAAGTGT
TTTTTCATATGAGTAGGTTAGTGACACTACTGAATACAAATTAACTGTTTTTGAATATACTGGAATCTCA
CAAAGTTTTTTCTGCCTCAGAAGTGGAATTCAGTTGAAGATGGGTCTGTCCTTAGAAGACCAAGTTATTA
TAGTTGCTAAAATAAAAATAAATAAAATAAAGACTTCAAAAAACAACAGATGCTGGCAAGGCTGTGGAGA
AATAGGAATGCTTTTACACTGTTGGTGGGAATGTAAATTAGTTGAACCATTGTGGAAGATAGTATAGCGA
TTCCTCAAGGATCTAGAACCAGAAATACCATTTGAGCCATCAATCCCATTACTGGGTATATACCCAAAGG
AATATAAATCATTCTGTTATAAAGATACATGCACATGTATGTTTATTGCAGTACTATTCACAATCGCAAA
GACATGGAGCCAACCCAAATGCCCCTCAATGATAGACTGGATAAAGAAAATGTGGTACATGTACATCATG
GAATACTATGCAGCCATAAAAAGGAATAAGATCATGTCCTTTGCAGGGACATAGATGAAGCTGGAAGCCA
TCATCCTCAGCAAACTAACACAGGAACAGAAAACCAAACACTGCATGTTCTCACTTATAAATGGGAGCTG
AACAATGAGAACACATGGACAGGGAGGGGAACAACACACTGGAGCCTGTTGAGGGTGGGCGAGGAGAG
GGAGAGCATCAGGACAAATAGCTAATGCATGTGGGCTTAATACCTAGGTGATGGTTGATAGGTGCAGCA
AACCACCATGGCACACGTTTACCTATGTCACAAGCCTGTACATGGTGCACATGTATCCCAGAACTTAAAG
TAAAATTTTAAAAAATAAATAAAGTAAAATAAGACTTTCACTTACTGGGCAGGCCCATGGTTTCTAGGG
TTGAGAACAATCTCCAGGGGCTTGACCCTCAGGAAGGGAGAATCCCTTCTTCCCTTGCAGGGAGCATGGG
CTGGGTGGCAGTTGTGTCCCTGCCATCTGAAAGTGAAAAGTGGACTTTAAATGTTGACTTATATCTCACA
ATACTATTGGTGTCCAGCTTCTGATACTTCATGGGACATTCCTTTGTACTTGGGATCTAACCTTATTAAT
TTAGAGAGAAGATGTAGATTAAGTTTCAAAAACCTGACCTTAGAAAAGATGTTTAAATAAAGAATGGGC
TATCATTTGTATTCGCAAATCACAGAGAATGTCCCGTGGCATGGAATCATTTGTCAAGCTCTGCATTCC
AATCCAATTTTTTATTTGCTCTCATCTCAGGGTGGTAATTGTTAATTTGGAGATTATTATTTAGGGTGGA
TTCAACAGTCTTACATGGGATTCTTTTTAGGGAGAATGATGGGAAATTACCCTTTTTCACATTTTTTTAT
CCTGGGAGAGGGGCCTCTATTCTTTCGCTCAGTGTGACAGTGAGAGTGAAGTGAAGAGAAGATTTATGA
TGCCAAGATCAGGGCTGAGTAATATGGTAAATCCCAGTTTATCTTAAGTGCAGTAAACCCCCAGGCAGCT
AGAAGAGTGACGTATTCTGGTTAGTTCAACATTCTATTTAATCTGGGAATACCGAATAGACCACTTTTCC
ACAACAGATTTTTATAGAATTCAAATACAACAAAATATACTTGACACCACAACTATACTGAACACATATT
TATCTCTTCTAATGACTTAAAAGACACTTAAATATCTCACCAAGCCTCAGAGTCACACGGAGAACATCAG
```

-continued

Sequences

```
TTATCTCAGAAACGGCTGTTAATAGGGATTTCTGGCTGATAGTGGGATGGCCTGTTTTGCTGATTGAAA
GCAGCACTTCATTGGATGCGGTGGGTGGGGGGTGGGACACCAGTTCTCGTTTTCCCAGGTATAATTCGGC
AATCTGGGGGGCTTCCTCAAAAATACGTAGAACCTAAAATAGATAATGTATGAAAAGCCCCCTAGTGCTG
AGCCTAACGCAGAAAAACATTCAGTACATACAAGATGACTTGACTCAGTTTATCTGTGATTGGTTTGGTT
TACTTTTGCTTTTTTCTTTTAGGGGTGGGGGAGCTCTTCCTACATAGTTAAGGGACCTTCAACTAGAGGA
ACTTGATATACCTAACCTAGGACAAGCAGGAACTTTTTGACCTCCAGCGTTGTTTATGGTTTCAGACTAA
GCAACAACAGAAGATAACTACAAGGAACTATCATGAATTATGGCTAAATGCTGAATGGTGACCCTTTAAA
TCAGTTATTAGTATGACTGGATTGTACCTTCTGCCCTGGGACAAGCCTAGACAGAGAGAGTTGGGAGAAG
CAAGTGTAAAAAAGCCTAGGTTGTTTTTCTTTTTCTTTTTTTTTTTTTTATATGCTGTTAATGGGAGG
GTAAATTCTTGTAAAGTTTTTGGAGAGCGCTTTGACCTTAATTTTGAAAATGCTAAGTTTACATAGCCTT
TGTCTTGGTAATTTCACTTCTACAAGTTTTTTCTACCTATGTGTAAGGATGTCTATTACAGCATTATGTA
TTTTAATTTTGCAGCAAAAAAAAAAAAAAAACTTGGGGAAAAAAAGAAATGTCTGTGTAGGGTACTGGCT
AAATTGGTAAACTGATATGAAATAAAATGCTGCTATTAAGAAAGGTGATGGATACATATGAACTCACATT
TTAAAATGTCTGAGATTATTGTAGAGGGAAAAAGTGGAAGTCTGTATGGATAATATATTTTATTGATG
AGAAAAAAATTAGATACATATACAAATGCATGTATATTCATAGCATTTTCTGGAAGGATATATAATATAC
TGTTCAGCTAATATATAATTTAAGGATTATGAGTATTATAAATTGAAATTAAATTATTACAAATTAATA
CAAATTAAGATTTGTTGATGTATACATAGTATTATGGTAAAATGAGTATAATTAAATTATTCAAAGTTT
GCTTTCTTACATTTGTTAAATATTTTCCAGTTTATGTTCTAATTTGCTTATTCCAATCTTTATTTCTATC
ACCTATATAATTAAACTCCAATTCAGTTTAGGGTCATTCATAATTTCCAAACTGATTATTTTACTGTTTC
TTCAGTAGTGTTGAAGATAATGATGATGGCACTAGTCATCCCTTATTGAACCCCTATGATGTGCTAAACA
CTTGTACTTATATTTTCTCTAAACCTCCAAAATTGTAAAAGTTGATGAGGAAGCAGAGGCCCTGCCATCT
TAAGGACTTGCTAAAGCCATGCAGCCAGCAAGTAAGTTTCAGAGCTAGCACTGAAACTCAGGTCTAACG
CCAAAGACTGTACTATTTCCATATGTCATTCTGCCTCAGATATAGAGCTGGTGAATTCATTTTTCAGGCA
GTGTCTTTGTGGGTAAGACAGATAGCTGCTTAAAAAGAGATAGAAAACATGCTTTGGATTGTTATGCTT
GCTAGCATTTTCCACTCACCATTGTTATTAATTATTCTGTGTTTCCCATTTGTCTTAACTTTGATCGTAT
ACTTACAAAGTTTATGGAAACTGCCCAAGTGCATTCGATTCGCTGATATTTCCATGGTCTGAACGCCAG
CCCTATGAGCAGGGGCAAATGGAGCATGCCATCTGAAGACTGCTCCAGCTTTCAGAGCTGGACCTGGTT
CAAATGGGAATGCCATACCACTGTTTATTTTAATGAGATAAAGAGCAAAGAAAAATAAAAAAGCAAAATC
TGCATTTGAAAACATTCAAGTAACGTAATCTGTATTAGTCGAACTAATTCTAAGCCTGGCCTGGTTTTGA
TTTTAGAGATTTCCACAGCTCCACGTGTACCCCCAGGGTGGCCATGTAGAGGTAACAACAACAATACTAG
GAAGACCATTCCAAGCCTCTGTCTCCATTTCTTGCTTTTCTGACACCCTTCACCTGTTCTTTATTCAGCT
ATTTACTGGGGCATGGTCTTTATCTGAAGTTTTTCCTGGTATTTTCAACCCATTAGGATAAGTGGGGTGG
GTGTAGGGGGCTGTGCCCACAAAACAGACATCCAACTTGGTTTTAGGAAAGGCTTTTTAGAGGAAATGAT
AACTACACGGAGTCCTGAAAGAGAAATCATAGAGGTAGAGGTGCCCACTTATCTAGGTAGAGAGAACGGC
ATGTGCATAAGGGAGAGATAAAAGGGCACACAGTACATCTGTACAGCTGTGAGTCCCCAAGCATCTGACC
TCTCTTGAATGAGGATATTGACTACAGGTTACTTAGTTGACCTTGTTAAAGCCTTATCATATCAGGATTA
CCAGGGTACAAAAACATTCCTAAAATAAATGGCTCTGTTACTAAACACTCCCCTTATAACACCATTGTTG
ACACTGTGACTTTTAAAAATCTCTCATATCTGGCCATACCTGTCTCACCTTCCTAAAGTCACACTGACAG
ATGACACACCAGGGCAAGATGAAAACTGTAGGGACTTGTGTAGAATGAAACGATAACTTCCTGTTCTTAA
AAGGGACTGTTGATATAATATCCTTTTTGCAAAAACAGGGAAATGCTTAAGGTTGGAGTTTCTGTTTTCA
ATAATGAAGATGGATATTCACATGAAAAGAAGACAAAAGAAAACAGAATGCCCCAGCTGTGGGCTAAGCA
GTTGGCTATTTTTATTTGTCAGGACAAAAACATCAAATGACAATTCTTTCTTCATTTCTCTTTATGAATC
TAGTACTAAAGAATGCTACTAAATCTTAAGTTCTATTAACTCCTGACAATGTATAAACTTGGGTTTACAG
TTTATATACACCACAGTTAGGGATTTCCATATATCCTCCAGCTAGTCAAGAAAACCTTTGTTTGGAGTTC
TTTACTGACTATTGCATCATCCAAATTTATTTTTTGCCTATGAAAACTGAAAAGGTGAAGACCAAATTTG
GAAATTCACGTGTGCCAATGCAGATATCAACATGAACAAAAGAAAAATACATGTATTGGACTTTGGAAAG
TAAAATCACAGACCTATTCTGGTTCAAGGTCAGCCATAAGTGGAATTGTAAAGAAAGGCCAGAAAATAAT
ATATGGTTCATACTCAAGAACAAGAATGGTCATATCATGTACAAAATGAATTGAGCTAAAAGATAAACAG
TAAAATGCTATGGTTTTTATTGTTAGCAGACTTCCACTAATTATAAATTAAAGGCAGTCAGTAATACCCA
TAGATTAAAAAGCTAGTTGAAAACTGAGATTCCTGTAGTAAATATTAAGCGTTGTGTGGTACATTAGTCA
CATGTGTATAATAAAGACAATAAATCCATGTAAGTACAGCAATGATGAAATGTGCATAAAGGAGTTTGAA
CTCCACAGAAGTAAGCAAAGTATAAATAGATAGCATGCTCAGGCACAGAGAAAGCAAGTGCTATTTTAG
CACTTGAGCTAGTAGATAATTTATTGTTCAGGCTCTCCAGTTGAGTCAATGTTTATATGGTGCTATATATT
AACTGAAACCAAAATAGTCTGTGCACATCACTGTCTTGGATAGATTACTGAGTGATCAGCAGAAACCATA
TCAAACAACCACTCCCCTACGAGTGAGGGATTTATAATATTTAAAATATTCATCCTAAAGCTCCAAGCTG
TTTTGACAGTTTTGTCTGTTCATAAATATTCTTCAAAGAGAGGCAGTATGGCATATGTAATGGAAAAGA
TAGTAAAGTGGTTAGCATTCCAAACTCAGGACCCAGATTGCCTGGGTTCAAGTCCTGGCTCTGTTACTTA
CTAGCTGTGTTGACTTTGGGCAAGTTACTTAACCTCTCTGTGCCTCAGTTTCCTCCTTAGTAAGTGGGGT
TAAGGATAGTACCTACCTCATAGGGTTGTGAAGCCGAAATAATTAATACAAATAAAACATTTAGAATAAT
GCCTGACACAGAGTGAGGGTTACTACCTAGACTCTGCCACAGATCAGCAGAATGACTTTAGATAGGTTAC
TTAACCTTGACCTTTGGTTTCTTCTTTGTAAGATGCAAAGGATAATAAACATCTTACAGTGTGACTGTGA
GAATCAAATGAGATACCATATGGAAAGCAGCTAGCCCTGAAGGAAAACACTTCAGATTTTCTTCTTCTTGT
CTCTTCTCATCCTTTCCCTTGCAGGGATATTTGTAAGGACACTTTTTTTAGCATCTCTGTATGTCAAGCA
CTTTGTTCCTACCCCACTCACCTAGCCTTGACCATACTTTGTGAAATCACAAATAGTCAGACGTTAGAAC
CCAAAGAATTGACCTGAAGACCTGTCCTTTTATCACGACACTGCTTTTCCATAGAAATACTTCCTTCAGA
AATCCTTTTAAGATTAATGCCACCCAATTCTGGCCTACTCACTTCTTCATGACAGTGTGGGCTGTATTTTCA
TTTGTGACACTGAATATGTTTGACCATTTCATGTATATGTTATGTCTTCCCAACCAAAGCCTGTGTTCTG
TGAGAGCAAGCATCTCTCATAACTCCCTCTGGTTAGCCTTTCTTGCCTGGCTTTCAGTCTGATTGGATCA
GAATTGGACAGGACCAGAGGATTTAGCAGGTCAGGAGTGATTATCAGCTGTGAAGTTGGCAGTGTCGCTA
AGGAGTGGAACCAAGATGCCCACTGCTTCTGGGGCCACATTGATCACATTCAGACATCCAGACCCTGGAA
AACTCAGGGTCGTTTCTGAGTCTACAGTCTACATTCAAGAAGAAGGGTAGAAATTCAAGAAGTGGCCAAG
AAAGACTTTCAACAACTTACTCGGATGTCATCAGGGGAAGACTAAGAGTATGGCCCTCAAGGCGCCTTCA
AGGATGGCATTACTTGCTGAATTCATCATGGTCGGGGGGCTTCAACAGTTTACAGAAGCCTTCAAATATT
TCAGGAAGCCTCTGCTTCCATCCTACTCTCCCCTGATGGGCTACAGTCTGTATTACAGCAGGAATCCTTT
TGCAATGAGTTGCACTTATCTTCAGGCAAATGCCCCAGATGGGGATATGAGGTTTTATTTACAGTCTGCA
AAATTTCCCTAAAGAGATTGGTGCAAAGCAGAGCTCTATGGACTTCCTCCTGGCATGCTTGAAGATCTGA
TCTGTTCATCCCTCAAAGGCCAGATCCATCTCTTAGGGGCTGACACCCATTAAAAGCCAACTATATAGGT
```

-continued

| Sequences |
|---|
| GTTCAAACAAGAATGCCAGTGTATTCATCTGTAATGAGAATATTTCAGATTAATATTCATGCTTGCCTGG |
| CCAGCCCATGCTCTCTCTGCAGGGAAGTTTTCCTAGGAAGCCAGATATGCTGCAGAGGCAGCTTGGTGAG |
| CACAGAATCTGAATACAGGAAGTTAGAGAGTGGGTCGGTGTCAAGCTGAGCCCACACGTGCATTCCCAA |
| GGTCTTCTTAGGTAGTTGGTCAAGGCTCCTTATCCATGGCCAAGGCCAGCGTTGGCCTCTCAACCAGCAG |
| CCGATGAGTCCCTGCTCTGATTGGTAGCTCTGTCTCCTGCAGGTACTCAGTTGAGTTGTAATCAAACACT |
| TCAGGATTGGGACCATTCTGTTTCTTTGCGGGGCCTTTTTCTCTTCTGCTCTGTCATGCGTCTGTGCCAC |
| TGTGGTCCTGGGGATGGTATGTTTGAGGGCAGGGCCCCATGCAGGCTCCTTCCACAGCATAATGGAGTGC |
| TGCCTTAAGATACACTCAAAGAAGGGTGGTGAGAGAGGTGTGTGGTTATTCTTGCTAACATAAATTGCAC |
| TGTTTAATGTACACAAGAGATGGGAAAAAGAAGAGAGCAAAAGAATTCTCTCCAGGCAAATGTTTACTAT |
| GGAAACTGTGTGATTACAGATGTCCATATACAATTCTCAGACATCTGTTTAAGCCCCCCGCCCCCGCCCC |
| ATGCAGAAGGCGATGGCGTGTTTCCTTTCTTCTGAACTCCTTCCACACATGGAATGATGCCATTGCCAGC |
| CCTTGTCTTCAGTCGCCTTTTTCAGAATTGGTTTACTTCTTGTTGTCTTTGAATTTTCTCTCATCTAGAG |
| GCTGCTTTGGCCCTCTGAGGTACCCACGGGCACAGCTGAGCTGATGGCCAAGCGCGGAGGCCCCATCTGC |
| AGCTGTCTCTCATGAGGAACAGCTGTCCCATGCCCATGGGGAGAGCAAGTCCTGTGTCCCAAACAGCTCT |
| GTGCCCCACCTCACCCTCTTCGCCATAATAGCTCAACTTCCATGAAGCCTGCTGTGTGATGTGAGCCACAAC |
| ACCAACTCCTGGGTGGGGTGGGGGGCATTTTCCTCTCCTGGAGCAATAGAGGAGCAGACACCTGCCCTC |
| TTCTTTCTCTCCCTCACTGCTAGCCCACAGCCAAGAGGGAGGTGTCCAGAGGGGTCATTTCCTGCCCTCT |
| CTGGTGGCTTGCCCTCCATGAGTTGCTGTTACCCCTTCTGCACGCTCATCTGCCAGCTGATCTTACTTCG |
| GGTGGAAGGTTTTGTGTTTGTTTTCCTTCCCCAGCACTTCCTTGTCCATAGCAAGGGGTGGGTCTGAGCC |
| CCACCATCAGTGTGACATGCATCTGCTCATTTGTGCATTGACAGAGATTCGTCAGTGACCTAGGCATGCC |
| CAGCTCGGTGCTGAGTGCTCCAGGCAGTACCGTGGCTTCAACAGTTTGCAGAACCCTTCAAGTATTTCAG |
| GAAGCCTCTGTTTCCATCCTGCTCTCCCCTGATGGGCTACAGTCTGTCTTACAGCAGGAATCCTTTTGCA |
| ATGAGTTGCTCTTATCTTCAGGCAAATACCCCAGGTAGGGACATGAGGTTTTATTTACCGTCTGTAAAAT |
| TTCCTTAAAGAGATTAGTGCAAAGCAGAACTCTATGCAAAATTTTTTTGTCCTACATGTGGTATGCATGT |
| TTGTGTGTGTAATAAAACTGCAGAGTTGATTTGCAGAATGGGCCAATGAAGCCTGTTTTATGGTCTAATT |
| TATGGCAGGAGAATGGAGTTTGCACAGCCACCCCTTGTTTCAGGCTGTTTAATATGCAGGGTGGCTGTGG |
| TAGCTGCTCTCTCTTCCTGTCACCCACCCTGTGGACATCCCCCGGTCTCAAGGGAGCAGCATATGTT |
| TTTCCACAGTCCCTTCTCTGCAGAGGCCAGCCAAGGACGCATTTTGTCCATCAGGTGTTAGGATCCTCGC |
| TCCATGCGGTCAGCTGGTGGTAGCTCTGTGTTTTCTCAGTACAGATGTGGCTGGACTGGCACTGGGACCA |
| CCTGATCCTCTTCACAGGGCTCTGTTTCAAACCGTGGGCTGGTGGCCAGACCCTCTTCAGCCTGAGCAT |
| GTCCAGGTGAATCTCCTGATTGTGCAGGCTGTGGCTGACAGCTCTGGATAGGGAACAGCTTCCAACCTTG |
| GCTGTCCACTAGAATCAGCCTGGAGTATTTAAAAGTTCTGGTGTCCAAGCCACACCCCAAATCAATTCTG |
| CCACACTCCCTAAGGATAAGACCCAGTGCTCTCCAAGTGATTTCACTGTGTTTGCAAGATTGAGACTAAC |
| TACTCTCTGGGAAAAGAGAAAGGAGGAAAGAGGAAGGCAGAGCAAGATAAGGGGAGAAGATTGGAACCAG |
| GGAGAAGGAAGAAATCAAGGGCTGGCCAGAGGTGGTGAAGTAAGGAGGTGCCCCCCAGCAGGTGCCTGGA |
| GATCCCCAGCAAAAGGACGATGTGCCTGCCCCATCTCTGACCCTGCACTTGGACGTGAGGAACCAAGAGA |
| GGCTCAGAAGAGGAGGCAGGGCTCCTTCTGTGGAACCTGCATGCATCTGCCCTTCCCATCAGACAGACTG |
| CTTCCTAGCCGTGGATTTCCAGATCCAGAGTTCACTGGAATGTCTCTTAGCTTCTGTTTCTTCATCCACA |
| AAACAGAGACGTCAAATCGTACTTGCAGGTTGTCATGTGGATTTGATAGGATGATGGTGAAGTTGGACAC |
| ATGTCTGACATTCTGCAAGGGAAGCTTAATGATGATAGACCTTAGAGAAGTCCACAACTCTATTTCAAG |
| TTAACCCTCCCCATAACTTCGTTCTCTCTGCTGTGCTGAAAGGCAGTGGTTCTGAAATGTTGTTTTAGGA |
| GAGCTAAAAAGAAACACAGAGGTCCGGGCTCACTGACGGGTCCAGGCATCTGCATTTTTCCCAAGCGCCC |
| TGGGTGATTCTGACGGCCAGTGCTTGGGATCCTCTCTACAGGTGAAGGTCCCAATCGCAAAGCTAAGAGA |
| GAGAGATTCTGTGTTGCTCACAGAGCTTTACTGCCTTCCAGGGCTTGTTTTGCACCTCCTAGTTGCTCTT |
| TCTAATGATTTCAGTGACTGTCCCACCTCAACATAGGAAAGAGGGGTATGCGAGGCGTGCCAGGGCCAGC |
| AGCCACACAGGGGTAATTTTGGCTAGGTTCCACCTTTCATTTACAAGTCAAACTGAGATGAACTCTAAAA |
| CTGGCATCCTCCAAATTAGTAACCTGCAGCCAAACAAGGAGAAAACGCTTTTTCATTTCTGGTGGCAGAG |
| GTAAAAATGACTGGTCTGTCTTGCATGTTGCACTTGCTTGTCCTGAAAGCTTTACATTTGGGGCCTCCGT |
| CGTGAGCCATGAGAGTGCATGGTGAAACAAAGCATCTTCTCCACATTAATATTTGTTTTTAAAGGCATGA |
| AAAGCCCCTTGGATCACAATGAAGCAAAGCGTCTGTACACTGACACGGTTCCACTGGGCATTGTGGGAAT |
| GTTGGTCTGTGGGAGCCCACAGGACCCTTGGTGGATTTACTGCTTATTGGTTTTGCTGGAACTATAATAG |
| GAAAAGGGATGTGGCTGCCCATAGGAGCAGCTACCGTAGGAGCCCGGAGAGGCCCGGGAGCGGGAGGGCG |
| AAGGGACCTTGATGATGGAGAGCCCCATCACTAGTAGTTTGAGAGCCCCATCACTAGTAGGGGGTCTAGG |
| AGCAGGGGCTGGAGACCCCGATCCTACAATGCAGCGGCAGGTCCCCCTGCGTCGCCGAGGCAGAGGTCG |
| CACCAAGGGCAGGACTCAGCGGGCGGGCAGCGAAGCAGGCACGTGGCCGTGGGCAGCCTGGGAAAGTGGA |
| AAACGCCATGGAGATTAAGCCTGGGGTGGGATGGGCGGTCTGGGGTGGGGTGGGCGGACAGCTTCTGCCT |
| CCACCTTCTCTCTCCAGGGGAAGCAGTGCTGCTCAGCAGCCCCCATAGAGCCGGGGAATCGGAGCAAGCG |
| GTTTGTTTTCCGTTTCACAAAGGAGGAGAAGGGATTCCTGCTGCAGTTTTTGCTGAAGAGCAAGACTTCC |
| GAGCAACACCCAGAGCGTCTGCTTGAGCAAAGGATTTTAATATCTCCCTGCCCTGCGCTTCCCCAGTTGG |
| CTAGGGAGCTGGTGTCGGATTCAGAAAAGCAACGTGGCTATAGGACATCAGTGTTCCGATGGCTAAAACA |
| CATTTTCCATAAGCCGTCAGGGGTTAATAAAATATCAGCTAGGCATGTGTAGTGGGTTTGGAAGGGAGAA |
| GAAGGGAGGAAAATGAAAGGGAAGAAGGAATGATGCCGAAAGGTAAGGTTTCCTAATCAGGTGAAGCAT |
| AGTGCTTAATTGATAGATTGCGTAGATGGCCAGGTGCTTTTGTAACTTGGGGCTCTGAGGTCTTTCATGA |
| AAGGGATAGCTAGAAGACAGGCATCACAAGACTGCAGAAGTCTCAGTGAGTGAGAAAAGAGAAAGCTAAA |
| TGAAGGATCAAGCAGAGAAGAAGGACACGGACAACAGCAATGAAAGCGAGCAGCGGTTGAGCGACTGGGG |
| GCTAGGCTGCATTCTAAACACTATAATACCTGGCAACGCCATTTCAGCGTCATAAGAACTCTCACCGGCGA |
| GTTAGGTACTATTATCATCCCCACCGTAGGAAGGAGGAGGAGAGGGCTTGATCGGAATCTCTTGACTTAA |
| GCAATGTGAGTGTCCAGCCAAGGACCACAGGTAAGATTCAGGCTGGGTAAAGACTGAGTCCTTTGCTGAG |
| ATATGCTCCCTCCCCTAGGTGGAGTTGGGAACCTTCGCCTCCTTACCTGCCTTCCGCACCGCAACATAGG |
| GCTTTCTGGGAACCAAGCCCATAGGATTAGAACGCCTTTGGGATCGTTACCTTTCCTCACCTTTACAAAT |
| AGCACCAGGAGAAAACATGGGAAGGGGCTCTTGTGTATTATAGCAGAACAGTTCCAAATATTTGG |
| GATGAGATGAGAGCCCCAGGGGCCCTAGAGGGACTCAGGATGGCCGTTTCGGGGGCTGGAATGTACGGTG |
| TGTCTGAGAATCTGGCAATGCTGCCAACCGGAGCAGCTTTCTCTCAGCCTGTCTCAAAGTCTCTCCTTTT |
| CTGCCCATGTCGAGAGAACGCAGACACCGGTTCTTTGCCCTCCACGCCAGCAGCCTTACTGAGCGCATTC |
| CCAACGCACAGGAAATGTTCAGGGGTGGGGGGACCAGGCATTCCCACGCTCCAGGGCAGAAGCTTTGTGG |
| GTGAAGGGCAGGAAAATAGGGTAAAACAGCCATTGGGCACTCATGCTGTGCTTCAGGAAGTCTGCTCCAA |
| GATTCCCAAGCAGGCTCAAGAATGGAAGCAGAGAGCAAGCCAGAAATATCCTTACTGCTTTATTTTATTA |

-continued

Sequences

```
TTATTTGTGAAAGGGCATGTTGGTGCTTTTCCATTAATTTTAATTGACTCAAGTCCCATGACTTTGGTGA
GCCCCAAAGCCTCCATAAACGCACGTCAACGGACTTTTTTTGTTTTTGTGGGCCTTGAACCCCTTGCCCT
GCCCTGCCGGGGAACCGGCCCTTGAAATTGGGCATGGCTGGGATTTTAAGCACTCCGCAAAGGCGCAGTG
ACAATTTCACAACAAAGCAGGGAGGTTGGGGGTGGGAAGGGGAGGGAGTGTTGTTTTCTACTCCGAGTAA
GAGAGCAACTGTTCTCTGTTTGTCCCCTGGGGCCCACTCTTGGCACCAGGCTGGGGAGACCTCAAACTTG
GTGTTGCAACATCCATCAGACCCAAGTGAGTCTGGGGCTCCTCAAAGGTGAACGGCAGCTGTTTGGATAA
AATTCTAAAATCTTGTTTGGGAGATTCTCAGCCCTTGTTTTACAATCGTTCTTCCTGGCAAAGAAACCAG
GAAGTTTTACTTTCCCAGGGATCTCAGGCAGGTAATTGTTTTCCCAAACTGTATTTTAATCTGATGGAAAT
GGACATTCTTTGCTCTGAGAACCTTCGCCCACATCCATAAACCGTTTGTATCCGCCTTGCGCATGGGAGG
CTCGATTACACAGCGCCCCGCCCTCCCCTGAGACGCGCTTCCATCTCTGGTTATAATTTAGGGCCATTTT
CATTTCTAAACAACAGTTACGAGCCTTTTAGTCTCTTGGCATCTCGGAGTGCTTTCCTGTTCAGCGGCGG
ACCACAGCCAGGTGGTGGGTGATCTCCCGAGGTTGGGAATTGGCAAAATCCCTTACGCGGTGTCATTTTT
AAGCAAAGCAGCATAAACGGTGACGAGCTGGTAGTTTCTGCCATAACCAATGCTTTCATGGCCCCCAGGC
TCCAACTGATTTATCATGAGGCCTCTTGCTCAGGGGACTTGGCTCACGCCTGAAACACCAGAGGCCCCGA
GTCTGGGCCCTGAGCTCACACTGGGACTGTGAGCTTAGGGAAGTGGCTGCACCAGTCCTTTTGGAGGTGT
GCACGTGCCCTCCTCATGCAGGCTGACCTGGCGGGGCTCTTATGGGGAGGAGGGGGGCTGAGTTAATTCT
CCACCCCTGCACTTTCTGGAGATGCGGAGAGTCCACCACAGGGAGGCAGATCCAGCCCTCCCTAGTGAAT
TAAGTGACTGCAAACAGAGTCAGCTTGGAAGCTTCAGGCAGGGTCCTACCCCCTATCTCCGCCCCTTCTT
CTTGGGGGCTGTTTCTTGACCCATCATTAAAAATGTAAAAGCCAAAACGTTTCAGGGGAAAAGTCCAATT
TGCCAGAATAACTTTGTTACTCATCAACAAATACTGATCTATCACACCTTGTGCTAGGTGCCTCCACGCT
GGAGAAGTAGCCAGCCCATTTAAAATGTCAGCAAAGATTCCAGTTGTCTAAACGCGCCAGGGACAGGCAA
GGAGGATAAGTGGTGTGAGGAGGATGCTGGGACTCAGCTGAAGTTGGAAAGCTCACAGCCGGTATTCAGA
GAACTGCAACAGGGTCCCCTGGGATATTAGCACGCGGGGAACCTGCCCCAGCATCAGAGGCCCTGGGTCA
GGCCTGGTTTCTTAGGTGTTCTTTGTGCTACTCCTCATTTTGTGGAGAGGCATCCTTGGTAGAAGTGAAT
TTTGTAAAATATGCAAAGGTATGGCTGAATAGTGAACTCTTCCCCTGTCCTCAGGAAAAGCACATTTGGT
ACCTCCTGTCAGAGGGGACTCAGCAATCCACTAAAGACTTTTTTTTTAATTTATTTTTTACTTTTGAAAA
ATGTTGGCAGGGTGCAGTGACTCACCCCTATGGAAGCGGGTGAATTACTTGAGCCCAAGAGTTTGAGACC
AGCCTGATCAACATGATGAAAACCCGTCTCTACTAAAAATAGAAAAATTACATGGGCGTGGGGGTGTGCA
CCTGTGGTCCCAGCTACTCGGGAGGCTGAGGTGAGAGAATCACCTGAGCCCAGGAAGTCGAGGCTGCAGA
GAGCTGTGATTGTACCACTGCACTCCAGCCCAGAAGATGGGAGTGAGACCCTGTCTCAAAAAAAAAAAAA
GAAAAGAAGAAAAACATCAAGTTCTTCGGGAAGGGTTGGGAGGTGATAAAGAGAGGCTGATTAATGGGTA
CAAACATACAGTTAGATGAAGGAATAAGTTATTGTGTTTAATAGCACAGTAAGTTGGCTATAGTTAGCAA
TTTATTATATATTTCAAAATAGCTGGAAGAGAAGATTTTAAATGTTCCCAACACAAAGAAATGATAAGTG
AGGTGATGAGTATCCTAAACACTCTGATTTGTTAGGTATTGTATGCATGTATCAAAATATCACATGTACT
CTATAAATATGTATAATTACTATGTATCAATTGTAAAAAAAGAAAGAAAAGACTATTACTGCCCTTGCC
CATTTACCCGCTACTACCACCCACTCACTCTTTTATTCACTGACTTATTCACTGTTTGATTTATTCATCC
TTTCTTTCACTCGTTCACTCACTCATTCAATCAACAAGCAGTCCCTGAACAAATGCTGACTCTGTGCCTG
ACACGGTCTAGGCAGGCAAACACCCTATTGGGAGCCGACAGGAGGAGGGTTTTGGAACCCTGGTCCCCAG
GTGCCTGACCACCCACATTGGCCTCCTAGGCTGCCCTCCTCAGGCCCACTGGGTCTCTAGTGTCAGAAAG
GACTGGCCAGAGGATGAGAGACAGACCAATTTGTTAGGTTAGGTCTCATCATTATAGAAAATATTGAATA
GTCTGCCAGTGATTTTATCTCAAGCATTCTCAAAACACTCATTTCCATCCTGCCATTGCTCCCCATGCTA
ATAAAGGAAATTCTTTCAATAGACCATGCCAAGTCCTGACCAGAGCGAACAGAACAGCTCGTCTAGGGA
AGCAGGCAACCAAACCACGCTGTGGGAGTTCAAGCTGAGATCATTTTTTAGATTTCCCTTTGCTTGAAAA
TTCCATCCACAATTTTCACCCACCTTCCCATCATCCCAAGTCATGTATCCTTCCATCATAACAAGTCACA
TCTCCAGTGTGAGTGCCTCCCATGTCACAGGCAGCAGAGAAGATTACAGTGAAACTATTCAGAGAGGTGT
GAGCCCCGTAGAAAGCTGGAGATCAGAGGATGCCCGTCTCTCAGGCTCCTGATACTCTTAAGAAGGTGTC
TAAATAGATTGTCTCCTGAGTAGTCCCAATAGCTTTGCTGTCTGATGTGGCGTGGAGCTCCAGACAACTT
TGTCTCCCTGAGAGTATTTTGGGCACCTGTGTAGTGGGAGGAGGAGAGCAAGGGTTGGGAAATCTGA
CTTTGAATCTCCTCTCTATCATTTACCAGCTGATTGATCCAGGCCACCCCTTCACTTCCTGAAGCCTGAA
TTTTCACACTTTGGGTTCCTTCTTAAATCCATTGGTAAAACAGGTTTAGCACCAATGGGGACCTTACATG
AACTAACAGGGCTGGAATTCACCTAGGTTGCCCAGCTGTGCTGGCTGCTTACAGCTGGCTGAAGCCTAGT
CTGATTGGCCTAGGTGCACACTATGCTGGTTGCTAGATGTTTTGAATATGACTTTTGGAAATAATATATG
TGAAAGTCTCTAGGCAGTACAACAGATGGTTAGCTAATTCGACTATAGCATTGGCTAGTACCACTCCCA
CGTCTAACTTAAATTATGTTTCATAATTTTTTTAATCAATTGACAAATGGAACAATCTTTAAATTTGCCT
GTATCTTTTGAGGGTCAACAAAGAAGTTATTCAGTGTTTAGGGCTGAGCCTTCTTTTCCAGTATTTTTTC
ATGAATGCTAGTGATTTGGTTGCCCAAAGTTCCAGGGAATGAACTTTATCCAAGCTTTGGAGAGTGACTG
AGGAAGTGCTTGTGGGGGCTTGCGAATGACGATAATATTTGAGGAAGGTGGCTTTTGACAAAATGTGGT
AGACTTCAAACAATGTCAAGACAGATACCCCTCAACCTGGATTTGTGGGTCAGTGTGGCATCTTAGGTGA
AAACGGCAGACATGTGTTTTTAGGAGTATGCTATATAGTTCTTAATGGAATTCCACAAAATTTAGTGTTT
TGGGGGAGATGACAGAGAGATTGAGGGAAGACCGTAGAACTTCTTAATGCTTTTTTTTTTTTTTTTTT
GAGACAAAGTCTCACTCTTGTCCCCATGCTGGAGTGCAGTGGCATGATCTCGGCATCCCTGCAACTTCCG
CCTCCTGGGTTCAAGCAATTCTCCTGCCTCAGCCCCCCGAGTAGCTGGGATTACAGGTGCCTGCCACTAC
GCCCGGCTAGTTTTGGTATTTTTAGTAGAGACGGGGTTTCACCATGTTGGCCAGGCTGGTCTCGAACTCC
TGACCTCAGGTGATACACCCGCCTCGGCCTCCCAAAGTGCTGGGATTACAGGCATGAGCCACCATGCCCA
GCCTCTTTATGCTCTTTATAACAGAAATGAATGTACCATTTTTTACTTGGGTCTCAGAAAAGACAAGTA
TGAGTTGGTGTTTAACATTAGACTAGGTTGTAAATTGAGAGGAGAGCCATCCACATACATCAGAAAAAGA
GGAGCAGAGAAGAAAAAAAAAACAACAATAAAAGACCTGAGACATCCATTCATCCACCCGTCCATGCGTA
CTAGAAATTCTGAGTTTCAATTGTGTTTCTCATTGAGTTTTGGGTTCATAGTCTTGGCTGGGTCCCTTAG
CATTAAGTGAAACAACTGCTAACCTAGGAAGTAGGTAATCTTTGTTTATTTATTATCTGTAAAATGAGGA
ACAAAAGAGTACTCATTTCATAGAGGTTTTAAGAATTAAATGAGTAAATACACATATGTGTATGTGTCTA
TATATAGTCATATATACATATAGTATTATAGATGTGTGTGCATCCTTTGATAATTAAATTACAGCTAT
GTATCCTCTCTCCAGAAAAATTCACAAACACAAGAAACTTAGCCTAATATTTTCAGAGATTTTCCAAAGC
CATGGGCCTCATTCCAATTATCCAAGTGAGGGAAACCCTTTCTATACTGAAATTCTTATTATGTTTTTCTC
ACTTAAAAGGAAACTGCAAGTCAAATTTGATTATAGTCAGTATTCTACAATAAATATTTCTTTGTGGTTT
TCATCCCCCTAAGATTTTTAAGCTCAGTCATGTCTAGAATATACCAAATGATAAGAAGTCTGATACAAAC
AAGAAGTCTTGTCCTATTAGAGTTCATAGTAATAGCATTTGATCTATAATAACAGAAAAAATATTGCATG
GACATACATTAATCTATTCCTGAGCTTAACTCCAGATGAGGAATCAGTTTTTATATCTCATTTGTACAGG
```

-continued

| Sequences |
|---|
| GTGGAGAGAGATGGGCTTTTTTCTTTCGATTTGTTTTTCCACGTCTATTTAGAGCAACCAAAATAGGAAA |
| ACTGCTGCACAGGTCTTAAAATTCACTTCCTCCATCCGCTTTCCGAATTCTGCTCCAGGTCTGATGACTA |
| TAACTTTTTATACATGTCATTTATTTTTATTTTTATTTTAGTCTAAATGTCTCTTCAAAAACACCAGGGA |
| AAAACATTTTTAGCTTCACTAAGAAAACAAACATGTTTAAACAACCCCCAAAATGTTCAGGTAGAGTCGG |
| TGTTTTTGGCTTGTGTGTATTTTAACGGTGAGCCTAGCAAAATATATGTTGGAAACAGAATTTTTCTTCA |
| TCTTACATGTGCCAGTTTCTTTCTGGAATAAAACAAAAAGGAGAATTGATCACAACTTCTATATTGGAGC |
| TAAACTTCTTGTGGTTGTGAAAGGTTATTTCAAGTTAAACAATATGATGTCTTTTTTCAGTTTTTAATTA |
| CGATTATGTGCCAGTTTCTTTCTGGAATAAAACAAAAAGGAGAATTGATCACAACTTCTATATTGGAGCT |
| AAACTTTTTGTGGTTTTGAAAGGTTATTTCAAGTTAAACAATATGATGTCTTTTTTCAGTTTTTAATTAC |
| TATTTATAGACATCCTGCGTAGAGTCAATCAATGGGAATGCAGGCTATGGTGCAAGTGAAGACAAAGCTG |
| ACCTAAAGGAGGAATGAATGCGGAGTTGAGATCCGTTGGTGCATCATGACTTTTCTGCCTTCATGATCTC |
| ATTGAATACTTTTACATTTTCAGGTAGAGTTGGTCATTTAGATGGGAATTCACTGTTTTTGTTTTTGTT |
| TTTTGTTTTTGAGACACAGTCTTCCTCTGTCGCCCAGGCTGGAGTGCAGTGGCACGATCTCGGCTCACTG |
| CCAGCTCCACCTCCCAGGTTCACGCCATTCTCCTGCCTCAGCCTCCCGAGTAGCTGGGACTACAGGCGCC |
| CGCCACCACACCTGGCTAATTTTTTATATTTTTAGTAGAGACAGGGTTTCACCGTGTTAGCTAGGATGGT |
| CTCGATCTCCTGACCTTGTGATCCACCCGCCTCGGCCTCCCAAAGTGCTGGGATTACAGGCGTGAACCAC |
| CACGCCCGGCCGGGAATTCACTGTTTACCATTTTGATGCCTACTCTCAGGGCATGATTGTTGAGTCCCCA |
| AAGACTCAAGTGGGAAAATAATAATATTCTGATGAAAAGCCAGATCCATCTCACCAGTTCTTCAGGACC |
| AAGCAGCATCAGGGTGTTTAGTGTCTGCGTTGTTCTTGCTCAACAGACAGATAAGTGAGGAATAATACTC |
| ACGAGTGAGGAGATAGTAGCTGTGCAGCAAGTGAGTACGTGAATGAAAGGATGTGAAAAGTAATTACGAG |
| GTGAAGTGCTCTGTCCATCTTTAGAAATTGTTCATTAGGATTGTGTTCATTCACTGTGTTTTTAAACTAT |
| TAATACATAAGACCATGCTAAGCTCAACATGCTCTGAATCATGGGAGTCAGAATCATCCTGTGCCTTATA |
| GGTATTAGCCCAATTACAGGTCAGAGTTGAAATCTAACTCTGATATATAACAAATGTATTTGATATTCTA |
| TCTAATTTGTGTATATATTTATGTATGTATCTATTTATTAGAGATGGGGTCTCGCTTTGTCACCCAGGCT |
| GGAGTGCAGTGGTGTGATCATAGCTCACTGCAGCCTCAAACCCCTGGACTCAAGCAATCCTTCTGCCTGG |
| GCCTCATGAGTATGTGGGACTACAGGCCTGTGCCACCACTCCCAGATAATTTTTTCTTTTAATTTTTTG |
| TAGAGACAAGGTCTTGCTCTGTCACCTAGGCTAGTCTCAAACTTCAAGGCTCAAGGAATCCTCCAGCTTT |
| GGCCTCCCAAGTGCTGGGATCACAGGCATGAGCTATGTGCCTGGCCATATTTATTATTTTTATCTCTTAC |
| AGCTTGAAGCATATTTACCATATATGGACTAGCTTTCTTTCAAAGTTTCATTTTACCTGTGGCATCATAT |
| AGCTGTTTTGTGAGTGCACTTAACTAGACTCTATTATAACTAGATGTTATCAATCAGTTGGTTATTGTCA |
| GTAACATCCCTTCTCATTTCATGATTATAAGTGCTTTGCCCTTGCAAGCCTTCTGAATGCTCCTGGGCCA |
| CCAGTTGCTAAGCATTTTCTTTACATGTTATCTGAGTTTATCAGGATCTCCTAACCTCCCTCACTCCAGC |
| AGTGAATCAGGCTCATTCACACCGTGCTAGTGGAATTGCAGGGTAGACACACTATGAGATATATCAGCAG |
| GCTATTTAAATCCTTTCATTTCCTAAAAGGTTAAAAGGCCAGATCTTAGAAATTAAGGTGTTGGTTTTTG |
| TTTTTTTTCTTAAATCCATTAACCTGGCACAGGGACTGATACTTGAAAATTACACTAGTAAACTCTGGCC |
| ATTGTCAAATGATGGACACGTATCACACATGGCTTATGAATACTTAGGCAAAGCATGGTTTTAGACATT |
| TTAAAAGTTCACTTTGAATTCAGAATAGAGGAAAACATTATAACAGTAAGAAAATCTCATAAAAGCTGAA |
| TTTATATATTTTACTAGCATTATTTCAAAAATAAATCGTTCCTTTTCTAATCTGCTCAAAAAAGTCTATT |
| TACTAAGAATACCTAAGAAAACATTGGCGTCTACCTGATTCTAAGTTTTTGGAAGAAGACACTCGATTGG |
| TGTAACTCTCTATCAGTGTCCAGCCAACTGTTGACAGTCACCCATGCTGCGACCTGTAGCTTGTGAGCCCA |
| GTGACCGTCCATGACAAGCCTGATTAATTTCATACCTGCTTTGCACATTATCGTTTGTACTTGTGTTTCC |
| TTATGTGCAAAATAGAAGTACGACTGAATGAAAGTTTTAAAGAGTGCAGATGGCCCCATGATTTGAAGTC |
| TTGAGCACATATAAAGGGCAGACACAAGGAAAATTTGCAGAAGGATAATGAAATGGGAGAAGAACTCCAA |
| AGTGGGACCCAATTTACTGGTCATATACCGAATGTGACTTGCATCTCAGAGTGTTAGTGGAGGACTTTCT |
| CTGACCTGGGGTTGGGTCTTTTCCGCATAAACACCAAAGATGGAAGAAAGGAAGCAAAATGTAATGTAGC |
| TGAGCTTTGGATGGATTAAGTCAAGGTCATATAAAACAGTTCCAAGCAAAAGTGGGGCCCAGGTGTCCAT |
| ATTACGAGTTGCTAACATTGAACACTGACTATGCACAAGGCACCATTCCAAGCTCATTGCTATATTATTG |
| TAGCCCATTGAAAACCCAAGTTTCTAGATGCTGCCTTGTCTGCTTGGTGTTGCTTAGTTCAATGAGTTAT |
| TCATTCATTAGTATGAGAGCTCACACTTACCATGTGCCCGTCACTGTTTTAAGCATGTCGTATATAGTAA |
| CATATTTTATACTCCCAAGAACCTAATGAGGTATGCACTATCATTAGCCCCATTTTATAGATGAAAAAAA |
| CTGAGGCACAGAGGCATTTAGCAGCTTGCGCAAGGTCATGCAGTGGTAAGTGACTGAGCCAGGTTTAAAG |
| CCATGTGTGTGCTGTTAGTCACCAAGTTAGGCTTCCTTCCACATACTGATCACTGATTACGGTCATAATA |
| TGGCTATTGATGACATGAGTTTGCTTGTTACAGTTGCAAAGAAACATTGAAAAATGTGTAAAAGAACAT |
| TAAAGGATCATCTCTATTCTTCTCAAGAGATAAGAATTTTAAATAGCATTAGAATTACTTTGATGACGGC |
| CACCGGCATCTACCCCTTAAAGAAAACGCGCTGGGCACGGTGGCTCACACCTGTAATCCCAGCACTTTGG |
| GAGGCCGAGGCGGGTGGATCATGAGGTCAAGAGATCAAGACCAGCCTGGCCAACATGGTGAAACCCCCTT |
| CTCTACTAAAAATACAAAAATTAGCTGGGCATGGTGGTCACACACACCTGTAGTCCCAGCTACTCGGGTGAC |
| TAGAGCAGGAGAATTGCTTGAACCCAGGAGGTGGAGGTTGCAGTGAGCCAAGATCATGCCACTGCACTCC |
| AGCCTGGGTGACAGAGCGAGACTCCATTGAAAAGGAAGGAAGAAAAAAAAGAGAAGAGAAGAGAAAGAA |
| AGAGAGGAGGGAGGGAGGGAGGGAGGGAGACAGGGAGGGAGAGAGAGGGAGAAAGGAAAGAAAGAAAAAG |
| AAAGAGAGAGAGAGAGAGAGAAAGAAAAGAAAGAAAGAAAGAAAGAAAGAGAAAGAAAG |
| AAAGAAAGAAAGAAAGAAAGAAGGAAAGAAAGGAAGGAAGGAAGAAAGAAAGAAAGA |
| AAGAAAGAAAGAAAGAAAGAAAGAAAGAAAGAAAACACGAAGGGAAAAACTATTCTGTCT |
| GCATTTAACTTAGAAAACAAGGGCCTGTTGTTTCTGACCGCCCAAAAGAAGCCCTCCATGGAATCGATTA |
| GGAAATAAGTGTCACCAGGGATGATCAGGTGCCTGCCTGTGCCTGTAGTGCTGGGAAGCCCATGTTAGAT |
| TCTCAGAATCAAGGCTGGAGATACTTCAGGAGAGTCAGCCAGAGGCTGGGAATTTTGCCTGTTTATTCAA |
| TGCTGTTAGGCCAATAAGCAGCTTTCATCAAATACAGTTAAGACCCCAAGATAAAGACAGATGACCGCTG |
| AGCGTGTTCAATCCTGAGGACTTGGGTTGTTGCTAGTTAGTTGTTGAGAATGGCTCCCCACTTTGGATTC |
| CAATAGGGAAAGTGCAATGTTTCTAGATCCCACCCTCAGGTCACCTTTTCTCTTCCTACAACATGCAGAC |
| CGCCTAAAAAGCCCTGGCATTCCAGGAGGACTTTATACTTCACAGAAGATGAGGGAATCTTTGGAAATTT |
| AGGCGACAGAGGCCAGACATACCAATAAACGGAGCAGTCACATTTCCCCCCAGTTGGAAACAGATCAGA |
| AGCTTTAGGCATTGGAAAATGCTAGCCACATAGCATTCTGAGTTTGAGCATCTCGTGGATGTCTGGCTGT |
| GGACGTCAGCTATGGATGACGATAAGCCTCCTGTGACTCTCCATGCAGAGTCATCAGTCCGTGTTAGAAC |
| TGCAGCCAGCAAAGAATGACCTCAGAGACTATGGATGTGCATCCTCCAGGGCCTCAGTCCCACCTCAAC |
| ATTTGGCCTGGGCGATCAGTTCCAGTGTTGACAGGTGGCAGCTGCTGGTGGTCCAAGGGGACTTAGGACA |
| TTTTTAATTGTTTTGTAGACATGGAGGTCTTGCTATGTTGCCCAGGCTGGTCTCAAGCTCATGGGCTCAA |
| GTGATCCTCCTGCCCATGAGCCATCACACCTGACCCCAGTCCTGTTTTTAAATGTGCCCAGGGAAGGAAT |

| Sequences |
| --- |
| TCTAAACCTCCTTTGTCAGACTTCACTTTGGCAAAATGATCCTTGGTACATTGGCAATGGATGGAACAAG |
| GAGGCATGGGCACTCTTGACACATTCTCCAATAGGCCCCTCTGCCTTTAGGCAGAACCACCTGCCCATTC |
| CAGCCAGATGGCAACAATCATGTTGTTGTTGTTGTTTAGAGAAAGGGCCCCACTCTCTTGTCCAGCCTGG |
| AGTGCAGTGGCATGATCATAGGTCACTGCAGCCACAAACTCCCGGGCTCAAGTGATCCTCCTGCCTCAGT |
| CCTGCTAATTCCTTTATTTATTTTTTTTTTTTTTGAGACGGAGTCTCACTCTGTCACCCAGGCTGGAGT |
| GCAGTGGTGTGATCTCTGCTCACTGCAACCTCTGCCTCCCGGGTTTAAATGATTCTCCTACCTCAGCCTC |
| CTGAGTAGGTGGGACCACAGGCATGCACCATCACACCCAGCTAATTTTTGTATTTTTAGTAGAGACAGGG |
| TTTCACCATGTTGGCCAGGATAGTCTTGATCTCTTGACCTTATGATCCACCCGCCTTGGCCTCCCCATAT |
| GCTGGGATTACAGACAGGAGCCACCACGCCCAGCCAACATCCGGCTAATTCTTAATTTTTTTTGTAGAGA |
| TGGAGGTCTTGCTATGTTGCCCAGGCTGGTTTCAAACTCTTAGGCTCAAGTGATCCTCCTGCCTCGGCCT |
| CCCAAAGCACTAGGATGATAGTCATGAGCCATCACACCTGGCCCCAGTCCTATTTTATTTTTAAATGTGC |
| CCAAAGAAGGAATTCTAAATCTCCTTTGTCAGCCTTCACTTTAGCAAAATGATCCTTGGTAGCTAGGCTT |
| TTCCTATAGCAAGAAGAGAAATCTGACTTAGAGAGAAAAGTTATGTATTTAAAATGTCCTAGAAGGCTAG |
| ATGGATGGATGATGGATGTTGGATGGAGAGAAAGAGAAAAAGAAGTAGATAAATGAATAGATGATATTCA |
| TGATAGATGAATAGATAGATGAAAGAGAAAGGGAGGTAGATAGATGAATGAAGGAAGGCGAGAAAGACAG |
| GAAATAGGTGACTGTAAGAGACAGCCAACCCCCTAGCAATGAGACATATTTATTATGAATTATACACCA |
| AAGGAGGCCTCTTAAAACCCATTCAAAACAGAAGCCACCTTCCTTCGTGCTCCCATCACCTTTCCCACAT |
| CCCTCTACTCCAGCACCTTCTCATGTTGCAACATTAGAATTTGTTAGCTGTTGGTCTCCCTGGCTGGAGC |
| ATGCGACCATAAAGCAGGGATTACATCTCATTCTGCCGTGTAGTCTCAGCATCTAGCCCAGTGCCTAGCA |
| CCTGGTCAGTGCTCCATGGAAGGAAAGACAAAAGGAAAGAAGGAGGGGAAGTACATCAGTCAACCA |
| ATATGATAAAGAAACCTGTATAAGACGATAGTGTCCCTTGTCAGGAATGCATCATTTCTAATGCTGCAAT |
| CATTAATGTTTTACTAACCAAACTTAACCTATGTGATACCTCATATCCCGTCGGTAAGCTGTCATACTCC |
| AAGTCAATACAGTGATAGCATCTGCCCAGTGTTGGAGGGGTGTGTTAATGCTCACTCCTGTTTAACACTG |
| TTCTAAGGGACACCAGTTCATTATTACTGTTTGTCTCCTAAATAATTTCCAAAAAATGTATTTCACCA |
| GGGTTCCCTGTTAATATGTATACGTTTTCCATGATCTGATCATGATATCGTATGGGCTTGGCCAGTGAGA |
| GCTGGCGCAGTCAACTGCAGGGTGTCCTCCCAGCCAGTGACAGTGTGGCTTCTGCAGGTACCTCGTTCCC |
| CAGTCAGGATATGCGTGCTGTCCAGGGTCCAGGGACGCCGTCCCTGCCCCGTCCAGGGTCCTGGAGCTGG |
| CTTGACTCCTCGCCTTACATCCCCAGTCCAAATCCTCTCGTCTTCCAAGGCCCATTCCAAGGTTGGCCA |
| AGTTTCTCCTCCTCCACAGCGGATCCTTCTCCCCACTCTGGGAGCTGCCTTGTCTTTCTCCTTAGCACTT |
| CCTGGTGTCACATTTCTTCCTGCCAACCACCTCTCTCTGGGGCATGGGACTGGGCAGTCTATAAAGCCGT |
| GAGTGCCCCCAAGCCCACAGTCCCCCTCCGAGGAAGCCAGCCAGCAGCTGGTCCTCATACTGAGGGCCA |
| GGCTTTGTGTCCTGTGGGTCTGCAACCCTGGCCATAACCAGTATTGGGATGAAGGACCCTTGTTTAACAAA |
| ATGACAGTGGACTTGCTTCAAGGCAGACGGCACAGCTTTAAAGCGATCCAGCAAACGAACTCTGCCCATT |
| TGGGGCATGTGATTTTTGACAATGACTGTCTGGCTCAATTAGACCCAACCTGGGAGTGAACTCTGTTTTC |
| AACATTGTCATATAGCTTGTTTGTTATTCGGACATCCCCTCGGGCTTAGATTCCACCCCCCTCCCCTGCA |
| AGCCTTCTCTAGATCCTAAGGTCCTTGAGGACAGAGTCTTGCTCAATCTCTTTTTGTCTCCCGCCAGTGT |
| CTGGGCCCTTTGCATCCCTTTGTAAATGTTTGTTGCACAGGTGACTGTAAAACACCTAGGCCCGAGGCCT |
| TCACCCCCAAGGAGTCAGTTTCTCCACGGCTCCTTTTCCGGTTGTGTAGCCATTTAGCCTGAGAGAGGTT |
| TGGGATAGGAGAGGTCTCTCCAGGATTCCTGATGAGTGTGGATGAGCCTGCTGAGCAGGGTATGGAAGCA |
| GAAGCAGCCATTGGCCAGGGATGTGGTTGGAGGGATAAACACAGAAGGATGCCTGCGGCTCCCCAAGCCAG |
| GGAGGTCTGCAGCTAGGGGCCTGGAAGATGGAAGACAAGGCAGTCAGAGAACAATGAAGACAGAGCCAGAG |
| CCATGAAAGTGACAGCAGCAAACCCAGAGAGAGGGACAGAGACCAACAGAGTCACACCCAATGAGGTTC |
| ATCCAAACCAAGACACTTCCCTCCATGGTTGTCAGCCCTGAGCTCCTGTTTCCTCCCTTGGGTTGTAAAT |
| TCCTCCTGAGCAGTGGTTGTGTTTATTCATCTTGGTATCCTTAGAGCCTTGCAGGGCACCACATGGGGGC |
| TGGCACATGGTAGGCGCCCAATAATAATTTTGAACCTGAATTGAATTAATAAAAATATTCTTCTATTTTT |
| ATTTATTTATTTATTTATTATTATACTTTAAGTTTTAGGGTACATGTGCACAATGTGCAGGTTAGTTACA |
| TATGTATACATGTGCCATGCTGGTGCGCTGCACCCAACTAACTCGTCATCTAGCATTCACATTTTCTTAAT |
| CCAGTCTATCATTGTTGGACATTTGGGTTGGTTCCAAGTCTTTGCTATTGTGAAAATATTCTTCTATTA |
| ATTGACTTGAGGATTTCACAGTCTCTCTTGAAAATCTATCTACAGGGCTACCAAGGTTTCCATTACCTTG |
| AACGCTGACGTTCACGCCTTAAATCTAACTGTCTTTCTTGCCATGGCTTAAGTTCATTTCTCCTCCAGT |
| GGTTTCAAATGCATGGAATGATTTTTCAGCCATTGAGGAAGAAGGAATGCTGTGTATAAAGCCTGGATTC |
| AATAAAGCCAGATTTTTGAAAACAGCTCTTTAGCATCTTCTACTACAGACACTGGTCTGGGCAGGGCTT |
| TTTATTTTATTGAATCCAGCTGAAGAGCTTGACTACATTAATAATGGGCTTCATTTCCAACCACTGCCTC |
| CCAGTCTTTCCCCCTAAAAGCCTCATGGTACTTAAGCAACTGCTAATACAGGAATAATTGTCAGTGGCAT |
| CACTTCCTGCCGTGATTTGACCACCAGGATGAGGTTTTCTTCTTGTACCTAATCTGGAGTTCTCAGGCAT |
| ACCATGTCTGGGGCTGCCAGATCATATTTAAAATTTGTAAGCAAATCTAATGGCAGCTGTGATTTGAGTT |
| GTATTGAGTTTATGTTGAGAAAGTAGGATTTGGGAAGATTCTTGGTGATGTAGTAATATTTTCTGGA |
| GCAAGCCTACCTAAAGATTGCCCAGAGGTTCAAATCTCTTATTTCTACAGAGCATGGAAGGGTGGTACCA |
| TATCACAGGGTCCTGAGGGCGGACTGGAAGATTTACTCCATTCATTTCAAAGAAAACTCTATTTGTTCA |
| GCTCCCATACCACCACCATACTTCTTTCTGAAGCTTCCCTGGAAGATGACATCTCACCATCAGTTTTCTT |
| TACACTGGACTTGACTCATGATGGATTTAGTACACATAACTGTAACATGGTATCCATACAGAAGATAAGG |
| TCCTCTTTGCTTGAATGAAAAAGGCCATATAAAAGCACACACCTATTAACAGGAATATAGCACAGCCACT |
| AAGAGCACAGACTCTGAAGAGTCTGATTGCCAGATTGCCAGAGTTTGAGTCTAGCTTAGCCACTATGTGA |
| CTTTGGACAACTTCCCTCCAATACTTTGATCTCCTCATGTGTGAAGTGGGGAATATAATAGTGCCTACTT |
| TTTAAAGTCACTATGAAGTTTAAGATGAATGGATATTTGTTAAGTGCTTAGATCAGTGCTTGTACACAGT |
| GCTATATAAATGACTATTGTTGTGTGTTTTTTTCATTTTACTGAATATCAATATTTATTCCTCTCCA |
| CATAACTTCCTACTAGGATAAAAAGTAAAGTTTCTCTTTCAGGCAACATGCAATCAAATTTAACAGCTGG |
| CCAAAAGTTTAGTAAGACCTTGCTTATTACACCTTTTTGGCAATATTAAAATAATATTTGTTTCAATCTA |
| AAGGTTGCTTCATCTGCTGTTATAGGGCTAGGCACTGTGGGGCCAATAGGAGTGAAATATGTGATACCCC |
| TCCCAAAAGAACTTGCAATCAAACAATATTGGAAAATATAAGAAGTGATATATTAGGTAGCAAAACAAA |
| CTGAAGACAGATGTGATGAACTATTGGAGAAGTTTAGGAGATAGTAGACATTAGTGACAGCTTGAATGGT |
| CAGGTGAGGAAGGTAAGGAGATTTTCAGGTGGGATGAGCTGAGCTGGAAGAATGGGTTAAGATTTGGGTG |
| ATGAAGGTAAGAGTGCTCCCAGAAGGTAAAGATACAGACAGTGGTAAGGAAGGGTGGCCAGCCATGGTGA |
| CTCACACCTGTAATCCCAGCACTTTGGGAGGCCGAGGTGGACCAATGACTTGAACCGAGGAGTTCAAGAC |
| CAACCTTGGCAACATAGCCAGACCCCATCTCTACAAAAACTAGCCAGACATAGTGGCACATGCCTATAGT |
| CCCAGCTACTCAGGAGGTTGAGGCAAGAGGATCACTTGATCCTGGGAATTCAAGGCTGCAGTGAGCTATA |
| ATTGCGACTGCACTCCAGCCTGAGTGACAGAGCAAAAGTTTCTCAATTTAAAGGAAGGAAGGAGGGAAGG |

| Sequences |
|---|
| AAGGAGGGATGGAAAGAAGGAAGGAAGGAGGGAAGGAAAGAAGGAAGGAGGGCAGAGTTTGGGGGTTTGG |
| GAGGGTGAAGGCATGGAAATGAAGGCTCTGGTGTCTTCCTTGGAGGAGCAGTGAGGATGCTGCCCTAGTG |
| GTAGCCAAGGATTAATTGTGCCAAGAGCATAGATGGTGCTAGAAAATCAGGCGACAGTAGCTGGATTATG |
| AAGGTCTTCACAAAGCAGGCAAATGAGTTCAGATTTGGTTTAATAGAAAATAGGAAGTGAGAAAGAGGTA |
| AGAAACACGATCTAGAATGCTGGCCAGCTGTGTCACCCGCGTGCCTGCCTGCACCAGTAGTGTCCCCGAG |
| CTGGGCCTGACACCATTCTTTGGTGATGGTGGAATAAAGGCAAGTTGAAGAAATAAAAACATGTTCATAT |
| ATGTGAGTTCCCAAGACAAACCACAGCAGATCCCAGGAATGTGTTTCTGATTGAGCAATGAAGACGTGTT |
| GGTGGGGTTTTGGTTGGGGTGGGTGTGGGTGTCATCTCTGTTTCATGAGGTCTAAATTTCTACTGGCTCA |
| GAAAAAGAACTTTGAGCAGTTTTTTGTTTATATGGGTCATCATCGTCTTCAATTTTTGTGGAGTTTTCTC |
| AGAGCTTCTTGATGGTCTGCTAATACTAAAATAAATATATTAGGCCTTTTGCCTGTCTCTTCTTTTCTGT |
| CACTGGGTGATGGCCTTTGTTTCCTCTAATGGACACATTCCAGATTTGAGTGCGGAGCGGGCAGTCCCTG |
| GCTGCTCATGTCTGACATCGTTCCCTCCCTGTGTAGCAAAGGGAAATCAACAGCACGTGGGAGGGGGAAT |
| CTGTGTTCTAAGAACTGCTTTGGTTTACACATCTATAGATAACACTCAACCAGCACTGCAGGTCACATGG |
| ACCGGCTGGTGAGGCTGAGGATGAGTCACTTTTAAATTACTCATAGAGAAAGAAATATGTTTCTGAAAGC |
| CAGAGTGGTTGGCTTACACATGGAGGTAAGAGAGAAAGCAGGCAGCTTCATAAAGCACTCAGACCTCCTG |
| TGACAGCTGACGTGGTGTGTAGTGCGTCAGGTGGGAAGACGGGGCCCTGCGTCCTCAGCAATGTATTTGG |
| AGGTGAGGCTTTTTGTTGATGGGAACCCCTGTGCTGGGACTTGGGGGTATTTAGGATACATTTCCATCTA |
| GCTAGACTTTCTCTTACAGTCCCACTTTGTAAATGGCCCTAGGACCCTTGATTAACTTTCAGTAACACAG |
| TCTAGTGGTGAACACCAAGCCATCTGAGGCTGAAATATGGAGAAGTATGTCAGTCCAACAGAAGGTCAGA |
| TGGGGAGGGGCGAGGGAGCTTTCAGAAAGTCTTGGAGTACAAGGGCCTCAGCTGAGCCTCGAAGGTCTTC |
| ATTCGTTGCAAAGAAGAAGGAATTCTGTCCCAAGCGAGATGGAAAGATCATCTGAGCAAAAAGAAAGCAT |
| CAGTGACAGAGGCTGCAACTTCATTTCACTGGCTGAGTCTAAATTTTTTTCACAGGAAAAAATATACAGA |
| AGACAAGAGAACAATCACCAAGGAAGCCCAAGGCACTGCTTACTAAATTGGTCCAAGGGGGGGATTTCAC |
| CAAATGCAAATGAACAAAGAACAATACATGTGACTCAAAATATCCGTTATGCTCTTAATACTTACGAGAG |
| GGTGTGAGGCAGGGAGGTGACCTTTTCAAGGGTTGAAAGCTGTCAACTTTTCAACCACATTGTTTTCATT |
| GCTGGGAGATTGAAGACAGGATCACCTCAGGGTACCATTTTGGAAAAGTGATTTAAAAAAAATTAAAAAC |
| TCCTTCCTGCATAATGTTTTGGGACATTTGAATTGTTTTTGCCGTGAAGACATAGAATTCAGGTGTCCA |
| GGAAATACTGCAACCTTTTATGAGAAATGAATACCCAGAAGTCTAGAGCTGCCTGGCACTCACTCTGGCA |
| GGTCTTCCACCTCTGGTCCCTCTCCAGCAGAAGGGCTAGTGAGCAGTTTAGGACCCCTGGAGCAGGGGTA |
| CCCTTACCCCCACCCCAAAGGAAGCGATGTGGCTTTTTTCTCGCAGCCCCGCCCCATCCCTTTGACAGG |
| TCACTAGAACAACAGAGTGCCCAAGTGGAGACAGGGAGGAATGTGATGGTTGGAGGGACCTAAAAATAAC |
| CATTTTTCCCTCATCCTGAATGTGCTACCCTGGGCCAGACATTCCCTGAAGGGCTCCTCTGAAATCTGGG |
| AAACAGGAAATGCTAAGAAAATCTCTAATTTGCCTGGTCATGTGAACTCCTCTCGGTGTTGAAACAGAAT |
| TTTGGAAGAGGGGACTCTGCACTGTGGTTGAGCCCTCCTAATCAGAGAACATTTGCCCCTATGAGAATAT |
| GGTGGATGTGACTATTCAGCCTCAACTTCCCTCTTTCTAAACATGTAAACTCTGATGCCTAAAGAACAAA |
| ACCAGAAAAGAAACCCACTCGGTCTTAGTTGCGTATCTGAGTGCCACAGGGCGGCTGAGAGGGGCCCAC |
| GTGCCTGTCGCTAAAAAGCCCCTTTGGCATTTCATAACAGGACCCAATCCCGCAGACTTGTCTGTGCAGG |
| CTCACGCACCATCTTCAAAACCTTTACTACCTGTATTTGTAGTAGATGATTAATGATTAGGCTTTCTTCC |
| CACACATTTGGCTTTGATAATCTCCACTCAAAATATTCAGATGCAAATAATTTAAAAACAAAGTGGCTC |
| CAAGGGCTCTTTCTGGGAGGATGGAAATGCTGCATATCTTGATAGGGGAGTGAGTTAAAGGGATGTATGC |
| CTTTGTCAATATTCATAAAACTGTACACATGATATATTCATTTTGTTGTATGTAAATGATACTGAGAATG |
| AAAACTCTTAAGATAATAAAGTGGGTTGAGTTTGGAAACCAGAAAAAGTGGACACGATGTAAATGACCCC |
| GCTGAAAACGATTCGAGTTGGCCAGCAGAAACTAAGAAATGCGTACGCGTGGGCAGTCCCCACTGTGCGG |
| GGAAATCTTTGCAAGGTGAGCAGATTCAGCTCAGCTCATAGAAACTCCAGCTGATTCTGCACATTCATCT |
| GTGTTTTTGTAGGTGTTTTTGGTGTCTTTGTGTCCATTTCTGTTTGGCTCATTTCCCTACTCAATTGGAT |
| TTTGACTTCTATTTCCTGAATACAACACCCCCGCAATACCTAATATCCCAGGCCTGTGAAAAGTGAATGC |
| CTAATAAATGTCCACTCACTCACTGAGATGGACTGCTTCTCCTGTCTCTGTTACATTCTATCAAAATTAG |
| CCAGTGCATTTGGCCCTAAATGCATTTGTAAAAATGGAAAGTAAAAGGAGAAACATTCATACTTGTACTA |
| GTTTTGAGAAAATTCCCAGTTATCTCTGCTTCTAAAAGTAATCCGTTTCAGAACTTTTACTTGGGAAAAA |
| TTGCTTTTGCCTAACAGGAAAAATAAAACATAGACTCCAGACGCAGTGATGTTCGTGTGAAATTAAGAAA |
| ACAGAGTTAATGTTGATGTCTTAGTGGAGGCGAAGGTACGCTTCCTTTCTCTCTTTTTCCCCCTTTTCAA |
| GGCAAATCAGAAGACCGGGTGTGGAAATTCCTGCAGGTTTGCTCTGTGTCGGTTTGCACGTTTGTAGATG |
| GAGTTTCATGCTTTTTCTCACTAGTCAGTCTTTTTGTCATCATCTCATCTTGAAACTAGAGAGGAAGGGA |
| ATGGAAGGGCAAATTGCTAATATCAGAGACCTCTGGAAATTCCCCTTTTATGGTACATGAGTATTTAAGA |
| ACAGTTCTCTTTCAGTTGTGTTTTTGTGATTTTGGTGACACTCAGTGGGCCCAGCCCTGCCTCTAGTCAG |
| ACTCCAGTGTCCTTCAGCAGCTCTCTAGGGCATGGGCTGGAGGCAGTGGGATGGGGGTTAACGTGAATT |
| GCACTGCTTTGGAAAAACAGCCCAAGAGAGATCCTTTTTTAAAGTAGATAACCTGAGCATAAATCTATA |
| CTCACATGATTTTTAAAAATTAACTTATCTAGCATCTTTTATAAACTGATAAATCTCTCATGAATTAATG |
| ACTCACCAGTGCCTAAATGGTGGGCAGACAGGCGGCGCTATAAATTTCTCTTGGCATTTTGTGTGTCATT |
| ATATATGATAAGTTCCAGTAATGGCCTGGCTTCATTGAAGGTTATTTTAAAGGAAGAAGCTTTTTATCCC |
| ACATGGTTTCAGGCAATACCTTATTGAAGATGACTTAGACCTTGGATTCTGGGGTTGGAACAGGCTTGTG |
| TCCACTGCCTAAACAGGGCCAGCACAGCTTCGTGGGGGGCCTCTGGAGGAAGGGGCCCAGGAAGGAGTC |
| AGGTCTTTCTGCTCACTGGCTGTCAGGCTGCCTGGGGGTCTCGGAGGGTCCAGAGCAACTGATGGCTGGT |
| GTGGAGGAGAGCGTGTGACAGCCAGTCCCAAGGCCAGGCTATGAGAGACTATGCTAATTAGTGAAGTCCC |
| TGGTAGGGCCAGGTCACTCGGCCACCAGGTAAAAAGTACCAGGTTATTTCTGCCTTGGCAGAAGGAGAAG |
| GTGCATGAATATTACTCATTAATACGCCTCAAGGAACCACTAGGTTAGACAACAAAAATAGCTTCTGCATC |
| CACTCCCCTATTACTTCCTCACTCCCCAAACATCCTTTCAGTCTGCTCCTCCAGCTTGAGAAACCAGGAG |
| GGTCTTCCTACCGAGTGGTGCCTCCCGAGCCTCTGGGGTACAGCTTGTGACCCTCCTCAATCAAATGAAT |
| CCCAGGGTTCCAGGCCAGGTGAGTATAGATGGACTTGGAGCTTTTCTTATGAAATGTCTTGAGCTGAGTT |
| TCTTTTTCCTGCTACGCCGAACTCTGTATATGTTTGTTTTGTTCTAATTTTGGCTTCAGAAAAAAAAAA |
| GAAGAAAAGAAAAGAAAAAGAATGTTTGGGTACAGTGTAAAAGTTTTCTCAGATCCAGATTGGAAACTCC |
| CTCATCACTCTGAAACCGGACAGGTGCTGAGCGGTATTTGTTTCTCTGTCAATAAACAGCACGTACTTGG |
| CCTAGACATAAACTCCTGCGGGAGCAGTGGTGCACATGGGCCTATTTCAGTGTTTGGGAAGGACTGAAGG |
| GCCCTGAATTAGGAGGAAGGTCTGCTTCTCACCCCTTCTCTTTTGATCTTCTGATAGAGACCACATAGTG |
| TTCTCTTCATGGTATTTTGATGGCATATGGCGTATAAACACAGGTGTGACCTTTACACAGTGCACTGCGT |
| TACAATTATAATAAGTGAGAGGAGATAAAGCCAGCTGGAGTTTAAGGTTAACGCTGAAAACAGCGAACGC |
| TAATTTTCACTGAAAACAATGTCACAGAGCAAGGCGTAGGTGCCCCTTTTCAACTGCCGCGTGCATGGTT |

-continued

| Sequences |
|---|
| CTATGAACAGCCCCAGGTGAAGGGTTTCCATGAAATAAGCCACCTCCTGGGGTACAGAAATACTTAGTGA |
| TGCATCCTCTGAGGATCCCCTTTGGGACCACCCTCCTGGGCGGCATATCCCAAATCCTTGTTTGGATGGG |
| AAGGGAGCATTAGGTAACTTCACTTGGAACAAGGTACCATGATTATGTCTGGTCCTGTTTTCCGTGCTGA |
| CAGGCAGTTCACCTCTCCGGGACTCAGTGTCCTTGATTTTAAAATAAGGGACTTTGACCATATTCCTTCA |
| GTTTCTTGCCTTCTGGTTTTTTACACAAGAGGCTCAGCCCAGAAGCCTAACCCCAGATGCATACTTAATT |
| CCTCGGGAAAACAAAATATTTGTCAGACCCACAATTAACTTAATTGTTTATTTGTGCAAAGGCTTTCTTG |
| TTTAGTTCCAGGACTTGCTGTTGAAATTTGAAAAAGGGTGGCCCCAGATTCATGTTCACATGAGTAGCTG |
| CGGTAGCTACTCACCAGCTAGCTCCTGGGAGAGAAAATGGAGAAGAAAGCGAGGGAAGAAAACGGAGGGC |
| AAATTCTCCAAGGTTTACTCCTCCACGAGAGAGACGCCTCCTGGGCAAGCGTTTCTACCTGGATCCCTGG |
| CTGCCCAGGAAATTGGGGAATGAGGGCTTTGGGTGTGGAGTCCCCTTGGCCATTATGAAGTCCATGGGGT |
| TGCAGTTACTGAGCAGAGTTAGAGGCATTCCTGCACCCCCACCCCCAACCCACAACGTCTGGACTTGGGA |
| GGAGATTCCTTGGCTTCTGAAAGAAGCTTCTGTTTCTGTTTACGTAAACATCAGGTGGACGGGGGAGGTG |
| GACGCCAGGGTGGGACGTTCTTGCAGTGCTCAGATGAGGGTGAGACTGGAGGGGCCAGTACAGGTGTTGG |
| GCATTTGGGTAGCACCTAACAATAATCTAAGGCAGTGGTTCTCCATGGGGATGACTTTGCCTTCCAGGGG |
| ACATTTGGCACGGCCTGGAGACATTTCGGGTTTTCACACTAGACAAGGGTTTCCGCTGGCATGTCGTGGG |
| CAGAGGCCAGAGAAGCTGCTAAACATCCTCCAGTGCACAGGGCAGCCCGTCCTCCCCACAACAAAGAATT |
| ACCTGACCCAGAATGTCAATTGATCTAAGTTCTAAAGCCTACTAATAGTTTGTAAGTTGAAAGCACTAGA |
| TTGACACAAACGGGAAAAGTTATTTGCAGTTTATTTTCCTGAGGGACAATGGGCTGCCACTCCCTTCCAT |
| GCTATTGCTGGGCAAGACTCTATGTTGGCTCTTGCTTTCTTCTCCTCTTTGAACACCCCCTCCCCTGCC |
| AGCCCGTCTGATGCCGTCCAAGCCTTTTTTTTTTTTTTTTTGGCTTCTCAGCAAGCCTCATGAATATT |
| AACTGGGACACTCAGGGCTAAAATGATCTCTGGTCTTACTTGAGAAATGCCCTCAAGCAAGAAAAAGAAC |
| AAGAGTCCCAAGAACACCAAGTGCCCCTCACCTTGGTCACACCAATGGCCCACACTGGCTGGGGAGGCGG |
| GGAAGGGTCCTGGGAGAGGGAGGATGGGCCTCTAACCTCCAAGGAGAACATGAGTGAGGGCCCCAGGAAG |
| GGAGAGGGTGCGACAAGCACTCTGGAGAAAGAAAGGAGAGGGTTCAAGGTGACCCTGAGCTCGGGGCAAG |
| ATCTGCAGGGCCTGCAATTGGCAGAGTGCCTGGCATCTGGCCAAGCAGCCCTCCCTCTCTTCCCGCT |
| CCACCACCTGCTCCTGGTCGCTGCATTGCCGGTTCCTCCCAGCCTCTTCTCACCTGCTCGCTCTAACGTC |
| CGTCTCAGCCAACAGCCCTACTCTTCCCTCCCAAGCCAACAGGGGGAAGCAGAGAGCAGCAGAACAGCCT |
| AAAGGCAACAACGGCAGTCTCTTTACCGCGCCCACCCTGCACTCCTGGGCCCCTGTGGCCTCCACCCCAG |
| CAGCTGGACCCTCCGAGACCCTCCTTTTCCCACCAAGCTCACCCCCACTAAGGGCCCTCCCCACGCAATG |
| CACAGCACATTCCACGCCCACCCGACATCAATACGTCCTGTCTCGTGACTCATCCGATACTGTTGACTT |
| GCTGTACAGTTTCTCACCTTTGCAAATGAGATTTGTCGCCTCCTCAAGTTGACTGTCCCTGGAGGCCAGG |
| AGACGTGCTGTGGCCCTGCTGTCCCGAGCCTTTCTCAGAGTCTCATGTTCACGTCCAGTTCTGTTGATTGG |
| GGACAAAGGACACTGCCATTTGCCACCTCTGCCCGCCCTGTGCCGACCTCCACCAGACGTTTGGCATCAT |
| GAGCCCGTGTCGTTCTCACCCCAGCCTTTGTGGTTGATGTTGTAGCGTCCTCTTATTCTTATAGATGAAT |
| AAGTTGAGGCTCAGAGATGTTAGATATCTTGGGTAAGGTGAAGCTGTGACGACTTGAGAACATAACTGAA |
| CGTTCTAGGCTCCTTACCCCACACGGTGTTGCCATTCCAGTCCCAGAAGGTCCTGAGGTTCTTTTGAGAT |
| GTGTAATGAATCCATCTTCCTTGAGCATAACACAATCTTTATGGACCTGTTTAAATAGTTTTAATTTCCA |
| TGTGTTTACTCATTCATTCTGCAAACATGCACACAGCTTTTACAAGGTGCCAGGCACTATCAGAACCTGG |
| GAAAACCAAGATGAAGAAAATGTAGCCAGTGCCCCAAGGAGGAGAGAGACAGGTGGCAGTGAGTTCACT |
| GGTGAGCCTTGAGGGGGCAGAATAAGAAAAGGGCATGATGGGGAGGTGGGGGCTTGGTCAAGAAAGGCTT |
| CACAGAGGAGGTGGTATTTGAGCTGAGTGTGGAGAGGTGTGCAAAAGGCAGAGTGGCATCCGACCTGAG |
| GATGCATGTGAGCCAGGATCTGTAGAGGAACGAGGCTGCAGCTGATGCTGCCAGTAATCACATGGAGTTC |
| AAGGCAAGCAGTGGGTGTGGGGAGAGGGGAGTCTGGAAGCGTGGGTCAGGGCCAGCTCGCCCTGTGGATA |
| ACAGGAGCCACTCAGGGCATTTGGATAAGAGAGAGGGACGCAACTGCTTTGTGGGTCTAGCAGACACCCT |
| GGGAATACTCCAGAGGGAAGCTGAATGGGGCAAGATGAGGGAAGCTCGGTTGGGAGCTTCTTGCCACTGT |
| CTAGGTAAGCCATGCAGTGGGGTGAACAGAAGTGGCTTCTGTAAGACCAGAAAGAGGGAGACATCCTAAGA |
| GACTTCTGTAAGGTGGAGATGACAGTGATGGTGTGTCCATAGGAAAAGAAGAGGGAGGAGTTGAGGATCA |
| CCCCGGTTTTTCTGCTAGGATATAGGCTGAGGGCTGTCAAGGGGGCTGATTAGACCCTTAGAGGCAGATT |
| TTGGGAAGGTGTAATCAGTTCCCTTTGTGCTGTGTTGGGTTTGATGTACCTGATGGATATGCAGATCTGT |
| TTGGTCGCAAACTAGGGTTTGAGGTTCAAAAGAGATTCAAGAGTCATGAGCCTAAAGGCTTCACAATAGG |
| GTTATAGCTTAATCCTTTCTGTACTATGAAGACTTCATGAATGTCCCAAAATCCACATTCAGGCCTGCCC |
| TTCCCAGAGTCATCATTGTCTTCTAGAAGCCTAGTTTGTCCCATTTCAGCTGCCCTCCTCTGGACTCACC |
| ACTGGCTTTTTGGAGTGGCCAGGTCTGTGTAGAGAATTCTGAAGGACCATTCCAGGTGGGGACCTCATG |
| GCTTAGTACAAGGTCCGATGTTCTTGCTGTTGGGTAGGAAATCCTGCCTTGATGAGTCTCAGGATTTGGC |
| TGGCCGCTCTGCCCTGACGATTTCAAGAAATCACTTCTGCTAACTCCAGAACTCTACTTCCAGGCCCCTA |
| GCTGATAATATACAGGTATTGAGCTTCATTTGAATTTTTTCTTTAAGAACTTACCTTGACTAAAGATGTT |
| AGAAAATAAGATCCTAAAATTAAAAATTACGGACTCTGCAAAAAGAGCTTAACTGGCTTCAAAAGTTTGA |
| CACAACTCCTTTCATATATGCATTTTCTGTAAGCTACTTGTAAATAAAGAAGGTACCTAGGAAAGGAAAA |
| TTGCCATCTCTGACAGTTCAATGCAAAATGAGAGAGGAATGAGAGGGAGTCATGACTGAATTTAGTGC |
| CTTTGCTGCCAGGCACTTCACAGAAGTCATTTCATCCTCCTGACCACTCGACAACTACAGCCTTTTATTT |
| TTCTCTGTTTTATGAATTCATAAATTTAGGCTCAGGGAGGTTAAATAACTCATCTAACATGAGTTAGATT |
| TAAGCATTGCAGAGAACGAGAGGAGAACTGATAACTCATTCAACTCATTGACGAATCTAGTAATTTGCAG |
| AGTTGAGGTTCAAGCACAGATCTGTCTGACTCTAATGTGTGCTCTTTCCTCTCCAATGCTACTAGCAT |
| GGGTGAGCTGTGAGCATTCTGGAGAGGGTGAAAAGTGGGAGGCAGAGGCAAAAGCTGAGTCAAATAGTTT |
| TCTCAGATGAGAGAGTGGGCAGGCAGTGGATATTCGTGCAAGCAAGTTGGACGCCGTCAGAAATCTGA |
| GCTGAAGTTATGTGGGTATACTCACGTCTTGTAGTCTCCGCTGAAGGACCCATTATCAAATAGGTGGAAA |
| ATACAAAAATTGAAGATATGGTGAAGCATTATCACCTGATCAACCCAGCATCCTGCTCTCATAGGTGGTG |
| TACAATTTCACCCAGCCCAAGTCATTATGTCTTCCAGGAGAAAGGAGGCTCTAGTAGGCACTGAGGACA |
| AGCACATGATAAGCTATTGTTTTGCCTCCTGGGAATACTTGGTTGGCCCTTTATTTTTTAGTAGCAAGAA |
| GATTTAGGAGTAGCACTCTGTATGTATGTTGATTGTTTGGCTTTGTACACAAATGTTAGAAAATTAAAGA |
| ATAGATTTGGTCATTGTCATGTCTGTTTGCCCTCACCAGACTTAGATATGGTTCTTTAAAGTCTC |
| AGGCATTTTAGAATAACTTTGGGGAAGGTATTTACGAATTAATTTTTAAAAAAACTCTTTCATTTTAGAA |
| TTTTCTTAAAAGAGATATGTTTTTAAAATTTCAAATACCTAGAATTGGGCAAACGAGGTGTTGCCAAGTA |
| GAGGCTCTGCTGAGCAAATAATGACCACATCAAAACACCAGCCCAAGGAAGCAGGCTCCGATTCTGCTC |
| CCAGAGCAGCACATTGGTGTGGTGTCAAATGCATGTTTCTAAAGAACTCAAACATTGTTTTCTCTTAGTT |
| AGATAAACAAACTCCTTGATGTCTATTTATGACTAGTTGTTAGTGAGTCTCTTGGAAGTCATACAAAGCA |
| GTGAGAACAAGAAGGTGTTTTGCAGGTTGGCTTTGAGTAAAGACCCTCTGTTTTGATCAGGGTCTTGGAT |

| Sequences |
|---|
| GCCCTGCTCAATCCCCTACTCGAAGTTCTGAGGGCATTTCTCTGATTGTCCTCCAAAACTGTCCTGCCAA |
| CTGCTATAGATTAAATAGGTAAGGAGCAGCTACTAAGTTTCCTTCTTCCCTCCCATGAAGGAGCCCGGCC |
| ATGAGATTTAGCCAATGAGCCCATTTAACTCTCTGTTTTCTAGCTCATTTATCCAAGGGTTCAGTGCACC |
| ACTGGAAACCTTCATATAACAGAAAGCCAGTGTTTGGGGGGCATTTGGTTTCAACTTGCTTGTGTTTGAG |
| CATTTATATTTATAATAGTGCTAATCTCTAAGGGACTCACATCGCATTAAGAGCTTTATCTTAGGCTGCC |
| ACGGAAACTAGCATGTACCAACATGACTGAGAACTATGAGAAATTGGGCTGGGCCTACAGAAAATTAATA |
| AGCTCCGATTTTCATTTAAATTATCTTTTCCATGAGATTTTGTTTTGAAACCCACAAAGTCGGGCCAAGC |
| CATTAGCATTCCCTATGCACACATTTATCCTCCCCCTGTAGCCTATGCTGTCCCCTCCCCTCGCCCCCAG |
| CCCCTCATCTGTTATCGCCCCCCATCTATTATCGCCCCCCTTGCCTGAGTGAACTCGCCCTTCTCTGAAC |
| CGTCATGGCCACCCCTTCTGCCACCAGGACATTCTTGCTTGTATTGCTTGCTCCTGACCTCATAGAAGGA |
| AAGGAGTAGTTGCATTTTTCTCTTGAATCCACCCCAGGGTTTTGATCATGCCAGTCATGTTACAGATGCC |
| CAGTAATTTCTGCTGGGTTAGATGTTAGTCAGTTGCAGGGTAGATTGGTGTTAGGGGAGGTAGCCCGGCC |
| ATAGGCAAAAAGTAGCTTAGGGTCACCGCAGTCAGTGTGGAGAAGGGAATTTTGGGGGGAAATCTGGAC |
| AGACGAATTTGACCAATCTATGAGGCTAATTATAGAAAAAAACACAAGAAGGGGGAAAATTTCTTTCAGT |
| AATTAGAGAGATGACAGAGAAGCAGGGAATGCCCCTGATTGCATTATAGAAGGAGATCAAGATGACTTT |
| GAGAAGTCATTTGCTGAAGGTACAAAGAGAGCTCAAGGTGAAAGGAGTCCCATTTTCCTTCTTGGTGGAG |
| GCGCAGCTTAGTAACCTTTGAGGAGTGTTGCCTGTCTTGCTAGGAAAAATATGACAGGAGTAGCCCAGTG |
| GAGGTTGGAGACCTAATACCCCTTCTCACCCCCAAACCTGATAACTCATTCTTAAGCATCAAATCTTATG |
| TTATAGTCCAATATTTCTGGACATTTTTCTGCCACAAGGTCTCCAGAATGTGTTAGCTTAGCTTCAGCCT |
| TATAGGAATTCATATTTAAATCGACTTCTTTTTTCCTACCTGGAGCTGCTGGAAATACAGACTAAAACA |
| GCTCACGGGAAGGCTGAGCAGAGTCTAATTCTAGAACTTGTGGCATGTTCATGGGACACGGAAAATACAT |
| AGAAGTGATGGTTTCACAGAGAAAGGGAAAGTCACTCCAGAGAAAACTGGAGGGAGCCAAGAAAATGCG |
| GAGAGAAAGTGGGGAATGGCAACCTCAGACGCAGAGGGAAAGAAAAACAAGAGAAGACGTACGTTAGCAA |
| TAAAAGAAAAAAAACCATCACAATGCCCGTTGGGCAGGAAAGTGATTTTTCTGCTTTTCTTTCAGCCCTC |
| CTGGGCCCACAGTATTGAAGATAGGAGCAGAGTGCATTCACTGGTGTCCACTCTTCAGCTGGGTGTTGCT |
| GAAGAAGAGAGAAACCTTAGCCATCTTGCCACCAGGTCACTCTCTTTCTTTCGTTTTCAGGCTGACCCAA |
| GCAAAATAGGGGAAAATTGCATCTGGACAAAGGAAACTTCTCTTTCTGTACCTAAAAGCCTCATGTCAGG |
| CTGGGCGCGGTGGCTCACGCCTGTAATCCCAGCACTATGGGAGGCTGAGTCAGGAGGATCACTTGAGGTC |
| AGGAGTTTCAGGCCAGCCTGGCCAACATGGTGAAACCCCAATTCTACAAAAAAACTACAAAAATTAGCCA |
| GGCATGGCGGTGGGTGCCTGTAATCCCAGCCATTCGGGAAGACTGAGGCAGGAGAATTGCTTGAACCTGG |
| GAGGCAGAGGCTGCAGTGAGCCGAGATCGCACCACTGCACTCCAGCCTGGGTAACTGACAGAGGGAGACG |
| CTGTCTCAAAATAAATAAATAAATAAATAAATAAATAAATAAATAAATAAATAAATGCCTCATGTCAGGA |
| GAACCCTTTCTGTAGAGAGCCATATAATTAAGCACTGTGTTTGTTCCAAACAAAAACTAGAGAAAGGGTT |
| AAAAATCAATATTATTAGTGACATCTCCTCTCTTCTTCACTGTTAATCATCTGCCGGTCACTGTCATAAC |
| AGTGTTATTTTTCAGGCCTGAAATGAAAATTGGCGATTACATCAAGCAAAGAGTTTGAAAGGAAGGCTGG |
| GTTACTGCATGATTATTCGGACTCTCCCTGTAAATACGTGAATAGTTCCAGCTTCCCCTCACATGGGTTG |
| AGGGTAACAGAATGACATCTCCCTGGGCTAGAAGAGAAACAGAGACAGAACAAGCGAAAGTCGTCTGGCA |
| CCAGCCAACAGTTGCAACTTATACATATAGCCCGGGACCGGTATGGGTCTGTGGCCTGTTAGGAACAGGG |
| CCGCACAGCAGGAGGTGAGCAGCTGGCGAGCATCACTGCCTGAGCTCCGGCTCCTGTCAGATCAGTGGCG |
| ACATTAGGTTTTCCTAGGAGTGCAAACCCTATTGTGAACTGTGCCCACAAGGGATCTAGGTTGGTGTGCTC |
| CTTATGGGAACCGAATGCCTGATGATCTGTGTTGAACAGTTTCATCCTGAAATGATCCCCCACCCCATT |
| CGTGGAAAAATTGTCCTCCACAAAACACGTCCCTGGTGCCAAAAAGGTTGTGGACTGCTGACATAAATGA |
| GCTTGATTCTTTTCTCATAATGTAAACGTTATCAAAGAGACAGAGGTGTCAGCATAAGCACGTCGCTGCT |
| CCATGCACACTTATGACTTCGTGGCTCTGGGCAGGCCCGTTTAGCTGGGAGTCATAGCTACATTTAGGGA |
| GGCCGCGTGATTGAGTGGAAAGGCAGGATATTTTATGTCAGAATTCTGGGTTTGAGTTCTGGTTTCATAA |
| TTGATTAACTAGGTGTCCTTGGAAAAGTTACGTATTCTTGGTCATCTCTAAAAGAGGGGTGACAGCAGTA |
| ATAACTTATCTGTGGCTTGTTGGGAGGACCACACTAGATGATCTATATGGAAGCACTTTCTCAACAACAG |
| CGTGCCATGTGAATATTTGTTTTTGTTTGTAATAGATACCTCTATAATAAGGAGAATGAGAAGGTTATTA |
| TTTCATCCTGTTTGTTCACTGTTTTTATTTAACAACTTTTTTTTTTTTCCTACTACATTCCAGGCAGCA |
| GGCCAGAGGCCAGGGAAATTCGTTGCCACTTCACAGTATCTCATTGGCATCATTGAGAGGTTTACTCCTGA |
| TCCAGCACCGAAAGACCATTTTTGGCCTTTAAAAATAAAGTTGAAAGTCAAGAGCCAGAAAGATTAAGG |
| ATTAAGCTAATTTTTAAAATAACAAATGTTTTCTTATATTCTTTTCTCATTTATATGGTGCTGGTAATTT |
| TTTAAATTAGATTTTCATCTGGGCATTTTATATTAAAAATGATACAGTTCCCTGTCCCTTGTAATTGCAT |
| TTCTTTTGATTTTCTTTTATTATGACTCGCATATCACTGACACTTTTTTCCTGGAATGTTAAAAGTATAC |
| ATCATCTGGCTAAAAGGAAAAAATACTGACTTAATAAAAATGGAAAAGAGAGAGAGAGAAAATGGATA |
| TTCTTCTCTTTTGGTTCCAAACAAGGCAAAGTCCTCATTCCTCGTTCTTCATACATGCCAAGGTTGATGT |
| CACGGATCCAAACCAGTTTTGAGTTATCTGAAATGGGGGGAGCGGGGAAGCGCAGTTCAACAATCTTCT |
| GAAGCTTGAAAAACAAATTTGTCACAGTCTGATAACCCAAAAATGACTGATGGATTTTCTCTGCATTTTC |
| CAAGCAGGGAGGGTCGGGCATGGAGAATGAAACATTCTGAGAAAAGACTTAAATGTGGAAACTTTTGGT |
| TCAAGAGGGTATTCTAGGAGATACAAGAAATATCTCCTGGGGGCATCCAAAGGGAATAACACTGTAATCT |
| TGAGTGATGTATGGTTCCATTGCCCGAGGAATAGGGATGAAAACTAAAACTCCTTTGGTTGGGGTATTA |
| ACTTATCATCAAAAGTTACCATAAATAATGGATATTGTTTATGGCTGAGAAGTAGGACACATCCAGAGAA |
| GACATCCCTTAATTTTTCATAAAATCATCTCAGTGTTATTGGAATATGTTTTTCATGCCATTTGAGCTGT |
| CGGAGTATCTCTTGGGTAGATTCTTAAGCAGAAATAGTTGGGACTTTACAAACCCTGCCTGGGATTCTAA |
| TGTCTGGTGCCATGAAGATTTTGGCTTGTGTTTCTTTTGATGTCTAGAATATCAAGAACATTCCTAGCTT |
| CTATATTACGGCAGGTCACGTCCCGGCTTCTTCTAGTAAAATCCCCTCTAGGATTCAAGCCTCTATTTGC |
| ACCGGTAATAAATGTGATGGCACATTGCGACTTTGAATGCAAGCCAGCAGGGCTGCAGGCACCTGTTTCT |
| CCCAGTGCCCCAACTGTATCAAACCCTTTTCATCCTCCCTGCTTTTGATGCACAAACATAAAACGGAGTC |
| CCAGAATCTAAAGTGATGTCACTTGAGTGTCACCAAGGACCTTTAGAGGACCATGGGGCATCTCTTCCT |
| GTTACAAATGAGGCTCTCAAAGCCTGGAAAGGTGAATCCCTGGACCACAAGTGGAGGAACTGAGAAAGGG |
| TGCGTCGACACTCAGACCCCACAGCTTGCCATTGTGTGGCTTGTAGAACCAAGACATCAGAACAGAC |
| CAGCTTATCCGGTTATAAATCTAGGATAACATGATGAGCTTCAGAGCCAGGGGTTGAGCTCTCCTGGGAC |
| TCCTCCCCTCCAAAGGATGTGTTCCATTGCCAAACATTAAAAGCTCCGAATTCTTGTTTTCTCGCCAAAA |
| GGTATTGTAGACATGATGGCAGTGAATTATTTTTTTCGCATTTAAAGTTACCCTTAATAAAATCACTTT |
| CTTCAGGTGGTGTACCAAGTTAGTAAAACATACCTGTTTGAATCTATATTCCATCAACCATGAACTTATG |
| CCTGGGGATCAAAAATTCTTAAAACCCACCAGGCGTGATCCTAATACTTTTTTCACAGTTTCTCGGGGT |
| GTTTCAGTAGGTTAGGATTACCTCCAAAGACATTTAAATGATGTTTCTGGTTCAAACGGAAATGAAAAGC |

| Sequences |
| --- |
| ACATAAAATTGTAAGACATAAGAATTCCAAGAATTTGGCAGAGGTGAAAACACACAAAGAAAAGATGAAA |
| TTTAGACGTTTTTATTCTGCTCCTTTATCCAACACAAATCCCTCTCCAGTTGTCCCATAACCACAATGCC |
| AGCATTTAACTCCTCAAGGGTTAAAGGAGGCTTGTAGAGCGGGCCTCTGGCTGACTCCAGCGTGGATCGC |
| AGGCCTGGCGTCCTGTCAGACTTCCACGGTCAAATGGTAACCACACTGCCTCTAGTTACCTCGCTCCATT |
| TCTTGGGGGGCTCAGGGACAGCCGCCATTTCCCCATCAGTGTCCACGACCAGCGTCCTTCTGCCAGGAGG |
| CGGGCTGGAAGGTCCCTCGCAGCTATGGCCAAGCCCTGGCTGCGGCTGCAGAAGTCTCACTTGTTTCACT |
| CGGCCAACACTTAATTTCTTTATGTATCTGAGGGAGTGGGGAATTAGTGTCTTCCAGGAAATTCAGGCTC |
| TGAGTTTTCTGTCCTAGACTACAACAGGCAAATGGAGAACGGGTTGTGGGGATCGGAGCTGAGGAATGAA |
| CTTCAGCTGATAAAATGCAAGACAAGGAGGGAACAGGAAAGCAAAGGACAAAGTGAAGGAGAAAAAAATA |
| AAGGGAATTTTGGCAGGGAAAAGGGATTTGGGAGATAGGACGGGAGTCCTGTCTGGGTTATAGTGAAGGC |
| AGGGGAGAGAGGTTTGGGGGATCTTGGGGACCTGGGCCGTGTCCAGCCATTTTTTGTCTCCCACCAACTC |
| CTCGCTGTTCAGCTACCCCACAGAGCAGGGTCTTGGGCATCCTGTGTGCTGAGGACAGAGCTGAGCTTAT |
| AGTCACTGTGCATGAAGGATGCTGTGATTCTGCTTTTTTGTTTGTTCATCTTTAATTTGGTGTATTAGAG |
| ATGTTGCACTGAACACATTCCCTCTCAGCATGCAACTGCCAAAATGCTGAAAGAAAGTGTTTGGCTTGTT |
| GGGTCTGACTGCAACAATCACAAACTTGCCTTGCAAACTTCTGGCCTTCCAGTAACACATCGAACATTAA |
| AGGATTAAATGCTTGGTGAGCAGAGCTAGGTTCTTGTAAAACACTTGGCAGGTAGGTTCCTAGGAATTTA |
| AAGGTATCTGCCTTTGTTAAATTATGAAGATTTTTTAAATGTGAGTAGAGAAAAGCTGTTTCCAGTCATG |
| AGGAGTCACGAGGGGTGCCTCCAGGAGGAGAGAGACCATGCAAGAAGCAGGTGACGGGGCAGTGGGGCGA |
| GCGGCCCAGAGAAGCCCCCCCACCCCCTGGATCTCTTGGGCAGTGGGGCGAGTGGCCAGGGAAGCCCCCT |
| GTATCCCCCTGGGTCTCTTCTTTGAGGGCTTATGCTCTGTCCGTGGTGTGGAGCCACTCTTGTTCATGCA |
| CGTTGCAGACACAACCACTTTTGGTCCAGCAAGAATAGTTGAGCTGATCACTTGAAAGGATCAAAATCCA |
| GTTGCCACTGTGGAAGCTCTGGGGCCACATATTTTAATATTCTAAATTAGGCCTCAAGTTGGATTTGTTT |
| TTGTGACTCAAGGAAATTTTGTTCTCTTTCACATTCTAGAATTCCCTGTGAAGCAGCCCTGTAAATAGGA |
| GGGCTTTTCCTGAATAATATGAAAGAATTTCTCTTTGGGGATTTGAGTCTATATCATACAACATTTTAA |
| AATACTCTTGAGATGGCACGTGCAGCCCTAGCAACAGGGCCAGACCACAGTCAAGGGCTTCCAGAGTGTG |
| CCGCACACGTTCCCGTGGGATCCAGCCTTGCACAGTGCCCAGGGCGGCGGGGGCGGGGTGATGGGGAAG |
| GTCCTGTGACTGGTGGTTTCTCCATGGTCACAGGGTCTTCTTTCTGTTGATGTGGCCCCATTCGCTCTGA |
| CTCACCCCTGACGGCATACACCGGCTTGCTTTAGGACCCACCACCAGGGTGGCCCCAAACTCCCATGCCACTT |
| CCTTGCCCTGAAACACCATCCTTGGTTTTCTTGCTTTTATTTGAAGTCCTGAGGCCTCAGCTCCTGTCTC |
| ACTTTCTGTCCGCCTTCCAGCCCATCTTAAACACTCTTGGTACATTTCTTGAGCGTTCCCTGTCACTCCT |
| CGGGACTTCCTGTTTAGCCTCTCATATTTATTGCTCCGGGGAGCCGGAGTTGGATCTTGTATGTCTTTT |
| CTGCTTCCTTTGGGAGAAGCAAAATATAGTTGAAAAGGTACATGCCTCTGGCAGTCATATAGTCCTGGATTC |
| GAACCCCGGCTTTGCTGCAATGAGCTGAGTGACTTTGAGCAAGTTGTGTGACCTTTCTGATGGCAGTCTC |
| TTCTGTCTAGAGTTGTTTGTAAAAGCCACCTTAATGGGCTTTGGCACCACAGTTAAATATCTCTTGTCAT |
| CCCAGATTTAGTGCCTAGCCAGAAGTAGATGCTAAATAAATACTTTTTAAAGTGGTTTGCCTATGGTTGG |
| ATTGCTCGATTCAGATATGTCCAAAAGATAGATCAAAGCTAGAGGGAAAGAAAGAGCTAAAACGAGCTATC |
| CAAAGTTAGCGCCAATTATACTATGAAAAACATGTTGCCTGTGGATCCAAGATTGGCCAAGGGGTTTCCT |
| CAGTGGAAATAGCAATTTGCTTGACCTAAAATTTCTCTTGAAGCCTTGACCAGCCCAAACTTGAGCTTAT |
| TCCTACGACCTTAGGTGTGCATATCTCTGAGTCATCCCATTGGAAGAGCGTTTACTGAGTACCTGATTTG |
| GGTGATGAGCATGATGTCCTGCCTTAAGGAGCTCATTGTCATGGAGTCAAGCTCACTATCTCCCCTGCAG |
| CACTCTGCACAATGCTGTGTGCAACTCAGGCGGTCAGTAAATGTTTGCATCCCTGAATGCAACCTGAGCC |
| AACTCGCTCCAAGGTTTCTGCAATGGCAGCAAGGTTCTGCCAGTGCTACACATGCATAGGCATGGCCACT |
| GACGACTCAGCTGCCAGTCCCACCTGGAATATTCTGGCTCTGCCATTTTTGCCTGAGGAATAGTCGGTGT |
| ATAAAGGCCCCGTAGCACAGTTCAAATTCCATTTGCAATGCAGCCAGCACATACTTGCATCCCTTCTGCA |
| GGCAGGGTCCCCCAGGCTCGCCGCTGCAAGCTGCAAAAGTGCTTGACCGGTCCTGAGCGTTTGACGGGAA |
| GTGACAGTTGCCTTGGAAGTGGATCTCCCAGGGGCACGACTTTTCTCGTGTTAAGTGCCCACTGCTGACA |
| ATGCTGACAGGCCTTGTACAGTGGGCACGTGTAGTGTTCTGACCTTGCTCCTGCCCCCAGGAGGCCAGCT |
| TCACTGGCTTCACTGTGAGAGCGTGTCCTTGGGTCAGGTCAGCCAGCTGTCAACTGTGCCCCTGTAGGTT |
| GTGCTGATGGAAGATATTTCAGCCCCTCCACTCACTTAAAACTCATCGATGATTGCTTTCAGCTTCTCTT |
| TTTCTCTTTCTCTTTGTCTTTCTGGGTCTCTGGGTCTCCCGTTTCTCTCTCTGAGTTTCTGTTTTTGCTT |
| CTCTCTCTAGTTCTATATACAGCAGTATCCTTCTTGCAACAGAAAGCATACTGTCAGAGGTCCTTCGCCG |
| TAAACAGCTATTCAGATGAGAGGCCACGCCAGCGTATCTTGTCCATATGTTAATGAGCCAGGATCCAGAA |
| CCACAGGCTGACCTGGCCCACCATTTACCTGTCCTGGTACTAACAGCTGCTGCCACTGACAGAGACTGCA |
| TTTTCCTTGTGATAGAGAGGTCTGCTGTCTTCCCTGGGCACAGGAAGACTGTCTGATGAGGAAGGAAGAG |
| GATTGTCAAAGAGCCAAGCAGTGTTCCTTGAAATGCATCTGGTTTATTCATGTTGAGTCTTTCCAGGTG |
| AACTGAACTAAATCATAAACTACAAAATGAAAGCAGATTTTTCTTAGCATGCCCATATGGAGCTCACTGA |
| GGAGTTCACCACCATCCGTCAGCTCCCCTTTGTCCCCCAGAGCACAGAGGATGTAATTGTTCTTCTCTTCC |
| TGATCGGTAGATTGATGGTGTGGATAAGAAGCCTCTCCCATGGGCTTCTCAGAGGATCATCGCAGTCACT |
| TTGACGGTCACAGAATGACCCATTGAGCTGCAGAACTGGGGAGCTGGGATCTGAGTAAGACTATTATACG |
| TTGGGGTGCTTTTGAGTGGGATGTAAGCAGGCTGTGAAGTTTCAGCCATTTGTGACTTACCTGCCCCAAA |
| CCAAGACAACAGAACCAGCACCATCCGGGGTGCATCTGGTCCTCGACAGATGTCTGGGCCTGCGGTAGG |
| TCATCAGGGCTCCCTGGAGCTAATGCAGTGTGGAGCTTCCAGAAAAGATGCCCAGGCTGATTTCTTAACC |
| AGTCCCAAAAGCAAGTGCCAGACAAGGCAGGGCTGGAGGCTGGCAGTGCCCAGCTGGCTGAGGATGCCG |
| CATCCTCCAGCCTAGTCTGCTTTGCTCTTTTTCTTCTACATACCCTCCTCCAGGTCTGAGGCCACTTTCA |
| GCAAATTCCTATTAGGACATGCAGGTTCTTTGTACTCCCCACACCACCAGCCTCAGTCAACACTTACTGA |
| TTTAAACAAGTGAAAACCAAACATTTGGCCCCTAACTCTGGCCCTCCACGTTTAATAAATGAAGGACTCC |
| CTCCCCTCACTGCCCCAGCAGCGATGTCCTGATGACAGCCGATTAGGCCAAGCTGCAGAACTTAACAAGC |
| ATCTGCTTTCAGTTCCCATTTTTGGCGTATTTTCATGAATTAACTCTTGCAGTGACAAAAATAGAGGGAG |
| GCAGCCTGGGCCATGCCCCGTGTTCACGAGTCACATGGCAGGTACAGGAGCCACGGCACGCTTGGCCCAA |
| ATCATGACCGACAAGTAGAGCATATTTGCCTGTCGCCAATCCCTGTGGAGCACACAGTGATTATGTTCTA |
| CTCACATACGGAGACAGGTATGGACAGTGGCGTGGGGTGGGAGGAGGACATGTGTGGCTCCAGATC |
| CCAAGAAAAAGAGTTGGTGGATCTATTCCAAACGCCAGTCTGCCTGTGGAATCCCAGCCCCTGTCAGG |
| CAGTGGAGAGTCCTGTTCGGTATTGAATATAATCAGAGCTTCCCACCTGCTCCCTACTTTAAGCACACT |
| GATGTCACCAGTTCTAATTAAAACTGGCATGAGAGGCAGAGGGCTTTGTGGGCATATGGGGTTGGGGTC |
| TGGGACAAATAACTTGGATTATGCTCATAAAAGCAAAGAGATTGGAAGCACAGAGGCACATCAGAGGTCA |
| CAGCTTCAGTGCTGTGCCAAGAAAGGCCTCCTCCTAACTCACAGCAGGAGGGTCTGAGGCCAGGTGGGGA |
| GAAGAGCAGTGGAGAAGTGGCGGATGGAAGAGATGGACCACACAGAGAGGAAGCAGGAGATCCTCTGCAA |

-continued

Sequences

```
TAGTTACAGTAACACAGCTCTGGCACGCACCAACAGAACCCAAGTCACATCCTCAAGGATGCACGAGAAA
GGGTGAAGAATAAGGTCACTAACTAGGTAAGCCCAGATGGTAGAGCGGAGAGAGACTTCTTAGAGGTTCG
CTACGGCGGAGTTTTCAGATGAGGAAAATTGAAGGTCCCAGGGGTGAAGTGAGCTGCTCACCTTACAAGT
AGGAGTGCCCCGATTGCTGCTCATGCATCCGACCCCTAACTTCTCATCCAGAACACAAACCATGCCACCT
CCTACTACAGTTCTTCCTTTTTTTCTTTTGGAGAATGACAGTGGTGCACATTTTCTAACCAGCAGCGTCT
CATTCCTCATTACACTTGTGAGCCGAGGATCCATCACAAGCCAGTACTTCTGTGGAATTCGATATGGTAT
AAAAATAGTTTAGTCCCTCTTCATGTCGTGTAAGGAACATAATTAAGCTCTTTTATTGGGATATAGTTCA
CGTGCCATAAAATTCCATTTAAAGTGATCAGCGCATTGGTTTTTAGCATATTCAAAAGGTTATACAGCCA
TCACCCTTAGCTAATTCCAGAACTTTTCCATCACTCCAAAAAGAAGCCCTGTACCCATTAGCAATGACTC
CCTAGTCTCCCCGTCTCCCCATCTCCTGGGAACCTCTAATCCACTTTTTGTCTTGATGGCCTTGCCTATT
TTGGACATTGCATGTCAATGGACTCATAGACAGTGGGTGGCCTTTGTGCCTGGATCCTTCACTTGGCCTC
ATGTTTTTGAGGGTCATCCATGTTGTTGCATGTGTCAATGCTTCGCTCCTTTTTTGGCTGAGTTGTAAG
ATTCCATTATGTGGGTAGACCACATTTTGTTTATTTGTTCATCAGTTAGTGGATATTTGGGTCATTTCCA
CTTTTGGCTATTATGAATAATGCTGATGTGAACATTTGTGTACAAGTTTTCGTGTGAACGTGCAATTTCA
ATTCCTTTGGGTGTACTAGGAGTTGAATTGCTGGGTCATGTGGTGACTCTGTTTAACTCTTTGAGGAATC
AGCAAACTGTTTTCCCACAATGGCTGCACCAGTTTACATTCCCACCAGTCATGTGCAGGGGTTTCAATTT
CTCAACATCCTTGCCAACACTTGTTATTATCTATTTTTAAAATTAGAGCCACTCTAGTGGATGTGATCTC
TCCTTGTGGTTTCGATTTGCATTTCCCTAATGACTAATGATAGTGAAGCATCTCTTCATGCACTTACTGG
CCATTTGTGTACCTTCACTGGTAAAATGTCTACCAGAATCCTTTGGCCTTTTTTAAAATTTAGCTACTTA
CGTTTTTATTGTTGAGTTATAATAATTAAGTTTTTTGCTGGACATATTTTCATGTCCAACACAATATCAT
AAAAGTGTTAAGTTTGTCACTTTATGCTTGATACTTCCCCCCGAAACAGTGAAATAGCATAAGCCCAAA
CAAGAGAGGGCTGAGCACCACAACAGGCAGGGCCCTCGGAAGCTCTAGCCAAAAGAAGGTAATGGAATGA
GGAAGGTAGGAAGAAAAATGAAGAAACTTCGTTTTAAAGCCAAAACACTGGAAAGCAGGTGACTGAGGCC
TGTGTGCTATATAGGCCCTTTCTTTAGGGCCTCTTCAGGTGTGCCTTAAAATGAGGACAGGAGCATGGGCC
TGTTCTCTCCTGGCAAGGCCACTGCTGGGCAAATGGGCCTGCAGACAAGACACAAAGTGCTTTGAATTCA
GTACTAAGAAAATTATCAGGCCCATGGAAGCCACTGGGAATATTACCAAGCAGTTACTATAGGGCAGGGC
ATGTGTCTTATTTAGCTTTAAGCTAAATACTCAGCACCTTACAAAAATAGTTTGGTTACTGAATGAATAA
GCCCGCTGAAGATGAGATTTCAAGTGCATATAGATACGGCCTTTAGTCTCTCTTGTTATGGTTTATTACA
CTAACCTGGTGAACCAAATAGCATAACTATTAACATATTTTTAGCACTTTTTGCTATAAATGCATTTCTC
CACCTATTTCAGAAGTACGTCTTTTGAATTACTGGACTGACCACACCTTCTTGCAGGAGGGACATGAGCC
CACAGGTGCCCTGCAGTATTTGCATAGCTAGTGCGGCAGTAGGGAACTTGGTTCTGTGCTTCCCTCCAGA
CACCATCTTCTACCCCAGCCCAGAAGGTAATTAGACTAAGGAATCCTCTGAGGTCCATCTCTGGAATAGC
CAGCTCCGGCTGAAGTCTCCATTAGCAGGTGGTTGGGGCCAAGCTTCCTCTGCCCTGGCCCATGGCATAA
GCCATCTTTGCACATTATTTTCAAACTGTGAAAATAATGCCAGAGAAAGGAAGCACCCATTTGGGCTTCT
CATTTTTTCAGCCTCCCCAGCTCCTGAGGGCCCTGCCTGATTTGCATTCTTAGCTAAATTTGCATAACAG
AACACACCAGAACTTCCCTGGACCAACTGTGGTAAGCGGGCAAGTTTTGTTTTTGTTTTGGGTTTT
TCATCTCCTGCCATGTCTCCAGCAGGTTTCTTGTTACATCCAAATGACATGGAGATTAGGTTTCACGAAT
GTCATTGGCCCATGTTTCAACCAGCCCTCCCCCTGGACCCAGAGTTCCTCCAAGATCAACCCCCAGGCA
CTGGAGATGGCTTTGGGGAGCAGCCTTCGCCAGCCTGGAGGAAGGCAAATCCTTGTGCTTCTCACGCTCC
CGTGCCTCTTCACCATCTCCGGCCCAGGCAGCTGTGTGTCCTTCAGTTATATGCTCAAGGGTTATTTTTT
TCCCTTTCCTTTTCCCCCAAACCCGGAAACAATATTTTGGGAGTAAAGGGAGGGTGCGGGAGGGAAGAGTC
ACAGGGGACAGAAGCAAGCATGCAGCTGCCAAAGCCACACTGCTCTGCAGACGGAACCCTCTAGACTCAT
TCAGCACAATGTGGCTGTGGAGGAAATCCTGCCGAGCCGATGATAAGGGGGGAAATGGAGTCACTTCCTC
ACCAGCTGCTTTATTCAGGTAGAAAAAAGTCCTCACTTCCTTGCGTGTGCTCTGCCGGCCACCACTCCCA
GCCGCCAGTGCGGCTTGCTCCCCCTCTTGCTCTGAGCCAACTCTGGTGTCAGGAGAATCTTGCTTGGCTT
CATGGAGCGCTCTTTCTGCAAGACAAGTGTCTGTCTACCCCACTTCCTCCTTCATGTCCTTTCTCTTTCT
CCTGGCGTTCTCTCTCACCTGACGGTTGCATGTCATAGATTCTGTGTGGCCGCAGTAGTCACAGATAGTA
TTGCCAATGAGTCTCCAGCCCTCTTGGTGGAATCTAGGATCAGGACATACCCAGTGGTCTCTACGTTTGC
ATAGATGTCTAGAAACAGCCTTTGACCTCTGGTCGTCTCCCCTGCCCTGCACCACAGGCACCAATGCTGC
CCCTCTTGCCAATGCCCTGCTATTGTCCTTTCACCCTCTTAGGCAGCACTTGTCAAAGTTTGTCTTCCTA
ATACTCCAAACATAGCAGCAGTCTCCTTGACAGAGGGGTTAGGGGCAAATGAGTTTGGAAAATGCTACT
CCCTTTCTTGGAGAATCAAGCACCTGTGAGTGGGGGTGATAATATTTACTAACCAATATAGCAGGGACAC
TGACCAGTCAGATCCCTCTGTGTCCTTGGGAACCGGCTAACCATCAGTCCCTGGGAGGAGGACACTAGAG
GCTGCTGCTGAAAGAAAAAAAAGCACTGAATTTTATCTAAGCCAGTCCTTTATTTGGTCTCTGAATACT
CCCCTTTTAAAAAATATTATCTATTAGGATGTTTGAAAAATCTGCCATATAGTAAAAGAAATCAGTTTG
TTTCAGCTCCACAAACATTTGCTGAGTTCCTAACGTATGACAGACACATGCTCCAGGGATCCAAAGATAA
ATAAAACATGGTCCTGCACCTCCAGGTGCTAATAGTTGAATGGGGAAGGCAGACATGTAAACAGATGATC
TTCGTATAATACTGTGAACAGGGAACAGCCGAGGATTATTTAGCTCAACCTAGGGATTTGGAGAAAGTTG
CTTGCAGAAAATGATTGAGCTGAATCTCTGAATGAACCAAAGTTGACTTAAGAGTGACAAGCTGAGCAGG
AGAACTAGGTTGGAGCCAGAGCATTGGGAACCTTAGACTTAAGCATGGAAGCAACAGATTTGATTCTGAA
TGGATCACTCTGGCTGCAGTACACAGAAGAGATTTACAGGCAAAGCACAAGACTCAGACAGAGGCAGAGA
GATCAGACTGGAAATCACAGCAGTGATCCTGGGGAGAGAAGGTAAAGGGAGAGAGAAGTGTTCAGGTGGT
AAAATTGGCAGTGCATCTACTGCCCTGTTCTGTCCTGTCCCCTGGCCTTTACCACTTCAGTGCTCACTAA
CTTCACCTCCAGCTATAAGAGATGTGGCATCTGTATCTATTTCCTTGATTGGTACTTCACCTGTGACATG
GCCAGCTAGGAGTGCTGGGGTATTGACATTCCATAGGAGCAACCTTCAACCAATGAATAGCAGGAGTTGG
TGTATAAATACCCCAGCTCCCTAGTCCCTCAGTGGGTTAACAAGAGCATGGTCTACACCGGCCCTCA
GATTTCCCTGGCAGGAGTAAGCTCTGTTTGCCGGTAGCAATAACTTGCTTGATGAGGTAACTCATGCATG
AGTCTTTTCCTTTTTTTCTCTCCCTTCCCTGCTCCCCTTAGAGTTCCTAGCATCATCTCCCAAATAAACC
ACTTGCACTCAAATCTTTGTCTTAGGGTCTGTTTCTAAGGGAGTCTAACCTATGGCCATGGGATTTACTG
TTGAATGAATATGGGCATGAGGAAGAGAAAAACATCTAGGAGACTCTGAGGCTGTAGGTTTACTTGATG
CCATAGCCAGGTTGAAGACAGGAAGAGAGGGAGGCTTGATGGGGGAGGTGATAGCTTGAGTTTGGGG
CAGGTTGATCGAACTCCCTAGGGGATGTCTTAGAAAGCAATTGGAATAAGTATTTGCCAGTTAGGGGAGA
AAGTGAGACTGGATATAAAGATGTTAGGAACATTATCATAGGGGTGGTATATAAGACCAAGAGAGTGAAA
GAGATTGGTCAAAGAGAGAAAGAAAATGTCCAGACAGAAGCCTGATGGCAGCATCGAGAACTTATCAG
AATAGGCCAGGGAGGAGGTGCCCCTGAGGGAGACAGAGAGGAAATTCTTCAGGAGGAAGGAGGTAGCCCA
AAGGGAGCAGAGTCACGGAAGACCCTCAGTGGTCTTGGTGTCCGGGGCATCAGAGCACCTACTAAGATAC
AACCTCACACCCAGTGAATTTAGCCACATGGAGGGTATTGGTGGTCTCTGTGGGGGTGGTTTCAGAGGCA
```

-continued

| Sequences |
|---|
| CAGTATAGGAAGAAGCCAGACTGAATGGGTTCAAATGTGGGTGGGAAGTGAGCCAATGAGTGTGGCTTGG |
| CAGCTTTTCTAGGAGGGCAGAGACAGAGAAGATAATGGTTAGGGTGGAGCACGCATCAGCACAGACATTT |
| TGAGGATACCTGAGGTCAGAAAGGAAGGATGCGATTGAAATTGTAATTGACAGCAGGGACAATTGACGGA |
| GGAAGGTTCCTGAAGCAATGGGAGATGGTGGAATCAGGGTGAAGTGTGGAGAGGAGCAGGGAAGGACAGG |
| CAGAAATGGACATTTGTGCATGGGCCAGGGTGGAAAGCTGTGGTAATTCTTGCCCAATGATCCCAGTTTT |
| CTCAGAGAAGTAAAAGGCAGTGTTCACTGCCAAAAGGTGAGGAAGATGTGTGAGACAAGTGGTGGCTGTT |
| GGGAACAGTCATCAAAAGGAACAGAAAAGATCTGACAAAGAATAAAGAATTGCTAGGTGGTGTCAGAACT |
| CACTGAGTTTAGAGACCATGAATTTCCAGCAGCACCTGCCTGCAAGGTTGGGTAACTTTCTTCAGCACCA |
| CTTGGAAGCCCAGATGAGACTTGTTTTGGGCTGGAGTCCAAGTTGGGCAGAGAGGAAGGTCGGGATGGG |
| AGGAAGCAAGTTGAGGGAGGCAGGGAGGAGGTTCCCTGGGTAGAGAGAAGAACCAGCTGCTTGCCAGCAT |
| TCTAACCAGTGACATGCAGGAGGCAGGTGAAACCCAGCCTTCACGCTCCTGTCCACCACGAATTTCCTTA |
| TGAATACACACTGTAAGGAATTTGCTTTACCTGTCAAAGTTTCACTCACCTCACCTATTTAAAAAAAGAG |
| CTAATATCTTTATTAGACATTATTAAACCAATTCAGGGAATCTGAACATACTTTGAGGTTCCTTCCAGCC |
| CAGAGTTTTCTGTTACAGTGATTCTCCCTTTCCTTTTTCTTCCTAACCCTAAAGTTGTCATGAGAGAAG |
| AGATCCCCAGAGGTCCCCATGGAGACAAAATTATAAACTCATGAAAAATAGAAATATCAAAGTCATTCG |
| ATAGCTGTGTTTGATTTCCCATTGGCATGGTCTGATTTTCTTTTTACTTTCTTCTTACTGCCGATGAGAC |
| TCTGCAGTCTGCAGGAACAAAATGGCGGCACCCATTGATTTAGTTTAGTTCAAATGTGCACATAGAGGCA |
| TTACCTCTCTCTAGAGTGTAAGCTCTTTGGGGACAGGGTGGCTTTTCTCCCTTAGAATTCCCTTCGATTG |
| TATAACGTCTGCATGCATAGTCAGCTCAAAGACTGTGGAATGTAGCTGAATTTCGAATTTGCTTATAGCC |
| AGCCAAGCCATATTAAATTTCCCCAGTATATAGAGAGCTGAGAACACACACTGAGCTCGGGGCCTGAACC |
| TCTTATTGCAGGCATTGGTCTGAGGGGCAGAGCTCATGAGAGTTCTTCTGGGCCAGGGTCTAAGGAGGCC |
| CTCACTTAACCGGGGGCCTGTTGCATGGTTCTAGGTCATGGCTGCTGCCTGGGAGCCCATGTCTCCCCAC |
| TACTAGACATCATCTCCCAGCATTTTTGTCTGTCAAATTATGGAGTCTGGATTTTTTTCAGATTAAGTAA |
| GCACTTAGAATGTAACATTATTCTATGTAGTATATATTGAAATATATTTCATAAATAGTAATATACATGT |
| TTGTATTGAATTAGAAAAGACAGCTAAGGAAAAAAATCAGAATAGCCTCTTAAATGCCATGTCCTCATGC |
| CTACTTCTGCCTTCAACGATAATCACTGTTAACATCTTTGCGTTTTCCTTTATATTATTTTTTCTGTTT |
| GTAAACGCGCACATGTATATGTTAGGTTTTTACAGAAGTGGAATCGTGTTTTGCTGACCGTTTTGTCCTG |
| CTTTACTCAATATGACCTTAGGAACACAATTTCTTGCCAATAACTATAGGGTATGACTTTTAATGCTGAA |
| CAGCACTCCATCATGTGGACGCGTCAGTCATCTATTTTCAGACATTTGTTTCCAGGTTTATGCTATT |
| ATACATAATCTGTGCACTTTATTATTTTTCCAAAATAAATAACTGGAAGTGAAATTACTAACAAAAGCTT |
| TTTAAAAGCCTTTTGATATGCATTACCAAATTCAAAAGGTCTCCATGTTTACCTTTACCTGGGCATAAGG |
| GTTATTTTGGGACCCCCGCCCATATCCCCAACCGGATGCCATTCTTTTCAGCACTTAGAATTAACCTTCT |
| CTTCCATTCTTGACAATCTGACCTTTTTTAAAAAAAAATTCTCATTTTAGGTTTACGTGAAATTTCTCGAA |
| GTGGACCAGGGGTGGTGGCTCATGCCTGTAATCCCAGCACTTTGGGAGGCCAAGGTGGGAGGATCACTTG |
| AGGCCAGGAGTTTGAATCCAGCCTGGCCAACATGAAACCCTTTCTCTACTAAAAATACAAAAATTAGCCG |
| GGCGTAGTAGAGGGTACCTGTAGTCCCAGTTACACGGGAGGCTGAGGCAGGAGAATTGCTTGAACCTGGG |
| AGCCACTGCACTCCAGCCTGAGTGACAGTGGCTCCATCTCAAAAAAAAAAAAAAAAAAAAAAAATTCTTGAAG |
| GTTCTGAACGGAAAAGGAAATGTTGGAGGATGGCTGCCTCCCAGGTGGGAGTGCTCCATGGCCCGGAGG |
| GGTGAGGACACCTTTGCTGAGTTTAGGAGTCTTGACCCTGGTCTGTTCCCGTCCACACCTACCTGGCCTG |
| GTTCCAAACCTGCAGCAAGGCTGCGGCTGGGAGTTTAGCCATCCTGTCCCCTTGGGCCAGCCCTGGGTGG |
| AACTCAGATCCTCTGTGGCCTCTGAATTGGAAATTTATGGGGAAGCCACTGTGGACAGAGCCACCAGAGC |
| TGAGGCCCTGCCCATCTCCTCCTCATAGGAGGAGCCGGTGCCAGCCTTTCCGTGTGAACCTGTGATCCGT |
| GAAGTCGGGTAAGCCCTTGCCAGTCCTGACATGAGCAAGGGACACAGAGCTTCCTAAATATATAGACTGG |
| GATTTTGTCCGAATCACATGACGACCCAGGTTTTCTTTTTCCCTCTTTGTTGCTTTTAATACATAAAATG |
| AGCATGTGTTTATTTAAAACAGCTTTCAAACTCAAACAAATAATGACAGACTGTTCAAACAGACTTCGGA |
| AATCGCCCCAATCAGGATGTTTGAAAAATCAGGAAGACTTTCTACGAAAGAAGCTTTCAGGTCATTTTAG |
| TCCCGAAGCCGCAGGGTCTCCTTTGCACTTTGGAATTGTAGAAGGGCAAAGTTTAGAGGCCAGCTCCAAC |
| CTCCAGGGGGTTAAATGACTTGCCCTCTAGCCCTACACTCTAATAATGTGTAAAGAAGGACAGATAGGTA |
| GGCATTGTATTATCACTTCCCATCTTTGACCAGAACACGGGATGTATACATTTTAATTCATAATTCCTAT |
| AGAAATTACGGACTATCCTCAGATCAGAAAGCTAAGAGAGGGAAATTGCTTCTGCAAAACGGCAGGCTCAG |
| CAGAACTTCTTGGGGGAAGGGCAGGTTGAGTAGGTGCGGAGCAGGTCTGCAAGAGGACAGACAAGAGCAA |
| GGTGTTTGTTCTGCCACGAGCTCACTTTCTGTATCCAATTTACAAATGGCTTTGAGTGACCTACGTTAAT |
| CTTCACAATAATGAATTTTATGGCTATGGATGAAGTAAATGAGGCTCGGGGCTGGGTTATCTGCTGAAGG |
| TTATAAACTAATAAAATATCAAAGCCAGGGTTCACCCACACTCCTCCTCCAAGTCCCATGCCCTTCTCAG |
| CCCCCTGGGATGGCAACAGCATCTCTATGCTGAGGCTTTGGGCCAAGAGCTGCTAGTTTAGCTCATCTCA |
| CTCTAGAAATGACATTGTTCTACGTAATGCATATCAGAAATGGCCTGTTAGGTTCATGAGAAGCACTGTT |
| ATTTGTGTGGGGGTGAGGGTGGTGAGAGGGAATTATTCCAGCTCTGAGGAGGTGGGGATATTTGGGACAG |
| CATTTCTTCTGCTCTCCAGCACTGTGTGCCAGACCAACTGGGAGAAAATGCCAGCTGGAGTATGTCCCTG |
| CATCCTCCGGTTTCCCAGGATGGCTTCAGGTCCAGACAGGACAAATGATCAGGGCTTAGTCTGGTTCAG |
| ATTTTGCCACACAAAACTCTGTTGATTACTAAAGGGATTCAGAGCCCGGCCACTGACCTTCTCAATGTCA |
| AGCCAAATTGCAGACAACCTATTGCCAGTGCCCTGACAAATTTGGGGTGTCTTTTGGCTGGGCTATTGGG |
| GGTTTCAGCCTACCCATCCCTCAGAGAGAGAAGCATGGATGGGAGGACTAGTTGACATTTGCAGCCGTGT |
| CTGTGATGTCTTGGGTTGCTCCCTGGAAGAGGCAGAGTTCTGGCTTGTGGAGAAGTCCTGACTCCTTCCT |
| GCCCCACTGATCCCTGCTTATATGGAGAGGGGTGTGCATCTTGGCAGACAATCATGATTGTGCCTTAGCT |
| CTGTGCTAAGAGCACTAAACACACATTTTATGTACGTCTATTGCCTCGCTTTTCTAACACTGAAATTTAG |
| AAATGTTTAACAATAGATATTTAAAAAGAAGAAGAAAGCCCTTGCGCCCTCTCCTGGTAAAAGTTAACCA |
| AGGACCTCCAAAGATGCAGAAGGCCCACTGGGTTAGCAGTCGCTGGTCTGGGCTAGCTGATTGTGCTGAT |
| TTGACCAATGCTGTTGACACACAGGATGGGTCATCTGTTCTTCTATGGTCTGTGATTACAGAGCATCTTA |
| TAAACCAGAGTTTCTCAGCCTCGGCCCTGTTAGCATTGGGGGCTGCCCTGTGCATTGTGGGATGTTGAA |
| CAGCATCCGCGGCCTCTGCCCACTAGATACCAGTAGCACCCTCACCCCAAATCATGACCACTAAAAATGC |
| TTCCAAACATTGCCAAATGTCCCCTGGGGACAGGATCACTCTCAGTGTGACCCTCGCCCTAAATTCTTG |
| CCTGCCTTTTGTAAAAGGTGGCATTGGTTGGAGGGCAATCCATGAGAATGTGAGGATGGCTCAAGGCAAG |
| CCCTTCATGATGTCTGGAAGCAATATTGATGACTGGTTAACTGAGGTCACTTCTAGGAGTTTGTTTCAAA |
| AAAGCAACTGAACAAATAGACAAGAATTTATATACAAAATATATCATGATATTGTTTATAATAGCAAAA |
| GTTTTAAACACTATAAACATGAATTTTTAAAGTATGGCACATTTTATATATCATGAAAATAATTGTATA |
| AATCTATATTTAATAATGTGGAAAGTTACCCTAACAATGCTTTAAATCCTCATCAAGACTACCTCAGGAT |
| TCTCAGAGGCTGTTACATATAGAAGGAGTAATTTCAAACAGATTCATAAGCATTTGGGTAAAGCATTAAG |

-continued

| Sequences |
|---|
| CCAAAGACCAATGATTGTATTCAGAAAGCTTAAGTGAACAAACATTTACTACGCACCTATAGTGCACCAC |
| AACCATGCCCAGCATGAGGGAGACAAAGAGAATCCCTGGTCCCACTGCTACAGCCCTTGCCCCAGAGAAA |
| GGGAACCCCTCTGTGCACTGTTGGAGCCCCTCCCAACAGCGATGTCCAGGGTCATGGTATGTTACTGTTT |
| CCTGTAATAAAACTGTGTGCTTTGAGTCAGGGTTGTTGGGAATAATGTGAAACTATTCTTGTTTTCTTCT |
| TCATCCTGAATAAATCAGAAGTAAAAAGAATTCATTTACTGATTTATATATTCAAATATTCATTCAGAAA |
| GTTGTCCAAATACTCATTGGACCCAAATGTGAAACATAATCTCCCCAAAATCTAGGAAATGAGCAATTGG |
| TGATTTGCTCAATCCAAGCCCATCCAGAGGGTAGACTTTGCTACAACACACTACAGACCCGACTTGAGAT |
| GGAGAGATAGGAATGGAAGGGAGACACTTTTTGTCTCTCAGGGACCTGCACATCCAGTGACACACCCCTG |
| ATCTCCTGCCTTGTGAGATCCACAATTTGAGTAAATGCAGAGTTGTGGTCGTCCAGTCTAGCCACCCCCA |
| AGAGAAACCCCCTGACAGCTCCCTTTCCCCAGGAGAACCTTGACCTTAGAGGTTGGCACTGCACCAGTCA |
| AGGCCGCCCTTGGCCCCTCCACTGACTGAGCCCTTGACTGACCAAATGCTCTCATAGAGCTGCCGTTAGC |
| CACGCCAGGGCATCAGCAGAGAGAAGGGTGCTGGTTTCTATCTGGGTTCAAAGCCTGGCTCTGCCACTTG |
| TTAAAAAGTCTCTTATTCCCTGCGATTCTCAGCTTTTTCATCTTCAGAACAGAAACAAATAAAATAACTT |
| CATAAGATTGGTACAAAGAATTAGCTGGATGAGAAAGCGCATGCCTTTAATCCCAGAACTTTGGGAGGCT |
| GAGGCAGGAGACTCACTTGAGCCCAGGAGTTCAAGACCAGCCTGGAAAGTATAGTAAGACCCTATCTCTA |
| CAAAAAATTTAAAAATTAGCCAAGCATGGTAATCCTAGGTACTCAGGAGGCGGAGGCAGGAGGATCACTC |
| TTGAGTCCAACAGTTCGAGGCTGCAGTGGGTCATGATTGCACCACTGCACTGCAGCCTGGGCAACAGAGC |
| AAGACTCTTGTCTCTAAAAAAAAAAAAAGAAAGAAAAAGTTTGGTACAAAGACTAAAATAATGCATGTCA |
| GACATTTGATAAGATGTCAACACTCAATCGAGGAGTGTGACGGTCATCATCATTGCTAGATTTTATTACT |
| TTTATGGATGGGCATGCTAGCTAAAATTGCAAAACCTCTAATATTTTCTAACTGCCTCTGCTGTTTTTCT |
| CCTCGGCCCTTAGCACTCTCTCCTAGACCATGTGATAATTTATATTGATTGCTGTCTATACTGTTCCACT |
| CAATGGAAGCTTCGTGAAGTAGGAACTTTTAGTCTATTTTATGCACTGCTGTATCTCTAAGATGGCTGGC |
| ACGTAAAGAGGGTCTCAATAAATATGCCTTGAATTAATGAAAACAGTGGTTTCTGAATCATGGCCTCCAA |
| AGAGCATTTGCCTTTTCCCCTCTCACCCTTCTGAAGGTGCCAGGCTGCCCTGGCAGGATGCCTCTTTTCT |
| CTGTGGGGTGGCATTCTCTGCTCTCTCTAATACTCTTTCTTTTTCTTCCCTCCTCTCCCCCAACTGCA |
| GGATGCCTTTGTGGAACTGTACGGCCCCAGCATGCGGCCTCTGTTTGATTTCTCCTGGCTGTCTCTGAAG |
| ACTCTGCTCAGTTTGGCCCTGGTGGGAGCTTGCATCACCCTGGGTGCCTATCGGGCCACAAGTGAAGTC |
| AACATGCCTGCCCCAAACAAATATGCAAAAGGTTCACTAAAGCAGTAGAAATAATATGCATTGTCAGTGA |
| TGTACCATGAAACAAAGCTGCAGGCTGTTTAAGAAAAAATAACACACATATAAACATCACACACACAGAC |
| AGACACACACACACAACAATTAACAGTCTTCAGGCAAAACGTCGAATCAGCTATTTACTGCCAAAGGG |
| AAATATCATTTATTTTTTACATTATTAAGAAAAAAAGATTTATTTATTTAAGACAGTCCCATCAAAACTC |
| CTGTCTTTGGAAATCCGACCACTAATTGCCAAGCACCGCTTCGTGTGGCTCCACCTGGATGTTCTGTGCC |
| TGTAAACATAGATTCGCTTTCCATGTTGTTGGCCGGATCACCATCTGAAGACGACAGGATGGAAAAAGG |
| ACCTGATCATTGGGGAAGCTGGCTTTCTGGCTGCTGGAGGCTGGGGAGAAGGTGTTCATTCACTTGCATT |
| TCTTTGCCCTGGGGGCTGTGATATTAACAGAGGGAGGGTTCCTGTGGGGGGAAGTCCATGCCTCCCTGGC |
| CTGAAGAAGAGACTCTTTGCATATGACTCACATGATGCATACCTGGTGGGAGGAAAAGAGTTGGGAACTT |
| CAGATGGACCTAGTACCCACTGAGATTTCCACGCCGAAGGACAGCGATGGGAAAAATGCCCTTAAATCAT |
| AGGAAAGTATTTTTTTAAGCTACCAATTGTGCCGAGAAAAGCATTTTAGCAATTTATACAATATCATCCA |
| GTACCTTAAGCCCTGATTGTGTATATTCATATATTTTGGATACGCACCCCCCAACTCCCAATACTGGCTC |
| TGTCTGAGTAAGAAACAGAATCCTCTGGAACTTGAGGAAGTGAACATTTCGGTGACTTCCGCATCAGGAA |
| GGCTAGAGTTACCCAGAGCATCAGGCCGCCACAAGTGCCTGCTTTTAGGAGACCGAAGTCCGCAGAACCT |
| GCCTGTGTCCCAGCTTGGAGGCCTGGTCCTGGAACTGAGCCGGGGCCCTCACTGGCCTCCTCCAGGGATG |
| ATCAACAGGGCAGTGTGGTCTCCGAATGTCTGGAAGCTGATGGAGCTCAGAATTCCACTGTCAAGAAAGA |
| GCAGTAGAGGGGTGTGGCTGGGCCTGTCACCCTGGGGCCCTCCAGGTAGGCCCGTTTTCACGTGGAGCAT |
| GGGAGCCACGACCCTTCTTAAGACATGTATCACTGTAGAGGGAGGAACAGAGGCCCTGAGGCCCTTCCTA |
| TCAGAAGGACATGGTGAAGGCTGGGAACGTGAGGAGAGGCAATGGCCACGGCCCATTTTGGCTGTAGCAC |
| ATGGCACGTTGCTGTGTGGCCTTGGCCCACCTGTGAGTTTAAAGCAAGGCTTTAAATGACTTTGGAGAG |
| GGTCACAAATCCTAAAAGAAGCATTGAAGTGAGGTGTCATGGATTAATTGACCCCTGTCTATGGAATTAC |
| ATGTAAAACATTATCTTGTCACTGTAGTTTGGTTTTATTTGAAAACCTGACAAAAAAAAAGTTCCAGGTG |
| TGGAATATGGGGGTTATCTGTACATCCTGGGGCATTAAAAAAAAAATCAATGGTGGGGAACTATAAAGAA |
| GTAACAAAGAAGTGACATCTTCAGCAAATAAACTAGGAATTTTTTTTTCTTCCAGTTTAGAATCAGCC |
| TTGAAACATTGATGGAATAACTCTGTGGCATTATTGCATTATATACCATTTATCTGTATTAACTTTGGAA |
| TGTACTCTGTTCAATGTTTAATGCTGTGGTTGATATTTCGAAAGCTGTTTAAAAAAATACATGCATCTC |
| AGCGTTTTTTTGTTTTTAATTGTATTTAGTTATGGCCTATACACTATTTGTGAGCAAAGGTGATCGTTTT |
| CTGTTTGAGATTTTTATCTCTTGATTCTTCAAAAGCATTCTGAGAAGGTGAGATAAGCCCTGAGTCTCAG |
| CTACCTAAGAAAACCTGGATGTCACTGGCCACTGAGGAGCTTTGTTTCAACCAAGTCATGTGCATTTCC |
| ACGTCAACAGAATTGTTTATTGTGACAGTTATATCTGTTGTCCCTTTGCCTTGTTTCTTGAAGGTTTCC |
| TCGTCCCTGGGCAATTCCGCATTTAATTCATGGTATTCAGGATTACATGCATGTTTGGTTAAACCCATGA |
| GATTCATTCAGTTAAAAATCCAGATGGCAAATGACCAGCAGATTCAAATCTATGGTGGTTTGACCTTTAG |
| AGAGTTGCTTTACGTGGCCTGTTTCAACACAGACCCACCCAGAGCCCTCCTGCCCTCCTTCCGCGGGGC |
| TTTCTCATGGCTGTCCTTCAGGGTCTTCCTGAAATGCAGTGGTGCTTCACCCAAGAAAGCAGGAA |
| ACCTGTGGTATGAAGCCAGACCTCCCCGGCGGGCCTCAGGGAACAGAATGATCAGACCTTTGAATGATTC |
| TAATTTTTAAGCAAAATATTATTTTATGAAAGGTTTACATTGTCAAAGTGATGAATATGGAATATCCAAT |
| CCTGTGCTGCTATCCTGCCAAAATCATTTTAATGGAGTCAGTTTGCAGTATGCTCCACGTGGTAAGATCC |
| TCCAAGCTGCTTTAGAAGTAACAATGAAGAACGTGGACGTTTTAATATAAAGCCTGTTTTGTCTTTTGT |
| TGTTGTTCAAACGGGATTCACAGAGTATTTGAAAAATGTATATATATTAAGAGGTCACGGGGCTAATTG |
| CTGGCTGGCTGCCTTTTCGTGTGGGGTTTTGTTACCTGGTTTTAATAACAGTAAATGTGCCCAGCCTCTT |
| GGCCCCAGAACTGTACAGTATTGTGGCTGCACTTGCTCTAAGAGTAGTTGATGTTGCATTTTCCTTATTG |
| TTAAAAACATGTTAGAAGCAATGAATGTATATAAAAGCCTCAACTAGTCATTTTTTTCTCCTCTTCTTTT |
| TTTTCATTATATCTAATTATTTTGCAGTTGGGCAACAGAGAACCATCCCTATTTTGTATTGAAGAGGGAT |
| TCACATCTCCATCTTAACTGCTCTTTATGAATGAAAAACAGTCTCTGTATGTACTCCTCTTTACACTG |
| GCCAGGGTCAGAGTTAAATAGAGTATATGCACTTTCCAAATTGGGGACAAGGGCTCTAAAAAAAGCCCCA |
| AAAGGAGAAGAACATCTGAGAACCTCCTCGGCCCTCCCAGTCCCTCGCTGCACAAATACTCCGCAAGAGA |
| GGCCAGAATGACAGCTGACAGGGTCTATGGCCATCGGGTCGTCTCCGAAGATTTGGCAGGGGCAGAAAAC |
| TCTGGCAGGCTTAAGATTTGGAATAAAGTCACAGAATTAAGGAAGCACCTCAATTTAGTTCAAACAAGAC |
| GCCAACATTCTCTCCACAGCTCACTTACCTCTCTGTGTTCAGATGTGGCCTTCCATTTATATGTGATCTT |
| TGTTTTATTAGTAAATGCTTATCATCTAAAGATGTAGCTCTGGCCCAGTGGGAAAATTAGGAAGTGATT |

| Sequences |
|---|
| ATAAATCGAGAGGAGTTATAATAATCAAGATTAAATGTAAATAATCAGGGCAATCCCAACACATGTCTAG<br>CTTTCACCTCCAGGATCTATTGAGTGAACAGAATTGCAAATAGTCTCTATTTGTAATTGAACTTATCCTA<br>AAACAAATAGTTTATAAATGTGAACTTAAACTCTAATTAATTCCAACTGTACTTTTAAGGCAGTGGCTGT<br>TTTTAGACTTTCTTATCACTTATAGTTAGTAATGTACACCTACTCTATCAGAGAAAAACAGGAAAGGCTC<br>GAAATACAAGCCATTCTAAGGAAATTAGGGAGTCAGTTGAAATTCTATTCTGATCTTATTCTGTGGTGTC<br>TTTTGCAGCCCAGACAAATGTGGTTACACACTTTTTAAGAAATACAATTCTACATTGTCAAGCTTATGAA<br>GGTTCCAATCAGATCTTTATTGTTATTCAATTTGGATCTTTCAGGGATTTTTTTTTTAAATTATTATGGG<br>ACAAAGGACATTTGTTGGAGGGGTGGGAGGGAGGAAGAATTTTTAAATGTAAAACATTCCCAAGTTTGGA<br>TCAGGGAGTTGGAAGTTTTCAGAATAACCAGAACTAAGGGTATGAAGGACCTGTATTGGGGTCGATGTGA<br>TGCCTCTGCGAAGAACCTTGTGTGACAAATGAGAAACATTTTGAAGTTTGTGGTACGACCTTTAGATTCC<br>AGAGACATCAGCATGGCTCAAAGTGCAGCTCCGTTTGGCAGTGCAATGGTATAAATTTCAAGCTGGATAT<br>GTCTAATGGGTATTTAAACAATAAATGTGCAGTTTTAACTAACAGGATATTTAATGACAACCTTCTGGTT<br>GGTAGGGACATCTGTTTCTAAATGTTTATTATGTACAATACAGAAAAAAATTTTATAAAATTAAGCAATG<br>TGAAACTGAATTGGAGAGTGATAATACAAGTCCTTTAGTCTTACCCAGTGAATCATTCTGTTCCATGTCT<br>TTGGACAACCATGACCTTGGACAATCATGAAATATGCATCTCACTGGATGCAAAGAAAATGAGATGGAGC<br>ATGAATGGTACTGTACCGGTTCATCTGGACTGCCCCAGAAAAATAACTTCAAGCAAACATCCTATCAACA<br>ACAAGGTTGTTCTGCATACCAAGCTGAGCACAGAAGATGGGAACACTGGTGGAGGATGGAAAGGCTCGCT<br>CAATCAAGAAAATTCTGAGACTATTAATAAATAAGACTGTAGTGTAGATACTGAGTAAATCCATGCACCT<br>AAACCTTTTGGAAAATCTGCCGTGGGCCCTCCAGATAGCTCATTTCATTAAGTTTTTCCCTCCAAGGTAG<br>AATTTGCAAGAGTGACAGTGGATTGCATTTCTTTTGGGGAAGCTTTCTTTTGGTGGTTTTGTTTATTATA<br>CCTTCTTAAGTTTTCAACCAAGGTTTGCTTTTGTTTTGAGTTACTGGGGTTATTTTTGTTTTAAATAAAA<br>ATAAGTGTACAATAAGTGTTTTTGTATTGAAAGCTTTTGTTATCAAGATTTTCATACTTTTACCTTCCAT<br>GGCTCTTTTTAAGATTGATACTTTTAAGAGGTGGCTGATATTCTGCAACACTGTACACATAAAAATACG<br>GTAAGGATACTTTACATGGTTAAGGTAAAGTAAGTCTCCAGTTGGCCACCATTAGCTATAATGGCACTTT<br>GTTTGTGTTGTTGGAAAAAGTCACATTGCCATTAAACTTTCCTTGTCTGTCTAGTTAATATTGTGAAGAA<br>AAATAAAGTACAGTGTGAGATACTG (SEQ ID NO: 40) |

Pig BCL2 (Gene ID: 100049703)
Location: chromosome 1 Exon count: 4
Range: 158337403..158518214 (180812 bp)
>NC_010443.5:158337403-158518214 Sus scrofa isolate TJ Tabasco breed Duroc
chromosome 1, Sscrofa11.1, whole genome shotgun sequence
CCAGCGAAGGTGCCGGGAGCCGAGCCCTCCCCGCCGGCGCGGCCGCGTCATCGCCCTGAGCGGGAGCGCGGG
GGAGGCGGGCGCAGCCAGCTCTGCCGCGCAGGAGCAGGAGGAGGAGAAAGGGTGCGCAGCCCGGAGGCGG
GGTGCGCCGGTGGGGTGCAGCGGAAGAGGGGGTCCAGGGGGGAGAACTTCGTAGCAGTCATCCTTTTTAG
GAAAAGAGGGAAAAAATAAAACCCTCCCCCACCACCTCCTTCTCCCCACCCCTCGCCGCACCACACACAG
CGCGGGCTTCTCGCGCTCGGCACCGGCGGGCCGGGTGCGTCCAGCCTTCATTTATCAAGCAGCTTTTCGG
AAAATGCATTTGCCGTTCGGAGTTTAATCAGAAGAGGATTCCTGTCCCCGTCCCCGGCTCGTCCACCGGC
CCCCGGTCCCTGTCTCTCTCCCGTGGAGGCGTGAAGCGGCCCCGCGGATAGAAATCCATGTCCGTGCCCG
CGCGTGTGGTGCGTGTGTAAATTGCCGAGAGGGGAAAAATCCAGGAGCTTCTGCAAATCCCGGACTGAA
AATTGTAATTCATCTGCCGCCGCCGCTGCCTTTCTTTTCTCGTGCTCTTGAGATCTCTGGTTGGGATTCC
TACGGATTGACATTTCTGTAAAGGAGAAGTCTGGGAATCAAACTGGAAATTCTCCTAATTTTTACACCTC
CTCCCCCAGCTCCTGATTCATTTGGAAGTTTCAAAGCAGCTATAACTGGAGAGTTCTGAAGATTGATGGA
ATCTTTGCCTTATGCATTTGTTTTGTTTTCACAAAAAGGAAACTTGACAGAGGATCATGCTGTCCTTAAA
AAATACAAGTAAGTTCTTTGCACAGAAAATTGGCTTAATGTAACTTTCAATGGAAACATTTGAGATTTTA
ACTTTTAAGTGCATTCGAGTAAGTTTAATTTCCAGGCAGTTTAATACATTCTTTTCAGCTGTGTAACTTG
TAGTGTGTTAAGCCCTGCTTTCACCCAGTGTATAAAGGGAAATGCACCTGATTTTGACTGATTAGTTTTT
TTAACCTTTCAGCATCACGGGGGAAGTAGACTGATATTAACAATAATTAATAATGTGCCTCATGAACTAA
AGATCCGAAAGGAATTTAAATAAAAATTTCCTGCATCTCATGCCAAGAGGGAACACCAGAATCAAGTGT
TCCGCGTGACTGAAGACACCCCCTCAACCAAGAATGCAAAGCACATCCAATAAAATAGCTGGATTATAAC
TATTCTCTCTTTCGGGGCCGTGGGGTGGGAAGCGGGGGCGAGAGGTGCTGTTGGTACCCGGCTGCTTTTC
CTCTGGGAAAGGATGGCGCACGCTGGGAGAACAGGGTATGATAACCGGGAAATAGTGATGAAGTACATCC
ACTATAAGCTGTCGCAGAGGGGCTACGAGTGGGATGCCGGAGGACGCTTTGCCACGGTGGTGGAGGAGCTC
TCCCGCACCGGGCATCTTCTCCTCCCAGCCCGGGCGAACCCCGCTCCCGCGAGGACCTCGCGCCGCCG
ACCCCGACCGCCCCGCCGCCACCGCCGCCGCCGCCGCCGCGGGGCCTGTACTCAGCCCGGTGCCAC
CTGTGGTCCACCTGACCCTGCGCCAGGCCGGCGATGACTTCTCTCGTCGCTACCGCCGCGACTTTGCCGA
GATGTCCAGCCAGCTGCACCTGACTCCCTTCACCGCGAGGGGACGCTTTGCCACGGTGGTGGAGGAGCTC
TTCAGGGATGGGGTGAACTGGGGGAGGATTGTGGCCTTCTTTGAGTTCGGTGGGGTCATGTGTGTGGAGA
GCGTCAACCGGGAGATGTCGCCCCTGGTGGACAACATCGCCCTGTGGATGACTGAGTACCTGAACCGGCA
CCTGCACACCTGGATCCAGGATAACGGAGGCTGGGTAGGTGCATGTGTGGTTGAATGTGAGTCTGGGCTG
CGCGTTAAGGGTCTGAGATGCAGTGGTTGGAGTGTGGGTGGGCTGCTCGACCAAGGGCGGGCGGATGAG
CAGTGCTATAAAATCAGGTTTGTGGCTTCCCTCCCCATTTCCCCTGTTCAGAGCTCTCTCCCTGCCAACC
GTACTGTGATCATTCCTTCCCGCCAAAACTGTTTGCCTTGCTTGCCAACCGTTGAGTTTCAAAGATCCAG
GCTTTGCTATTCAGTAGGCTCTTGGGATAATGGTATCCCTTCAGTGTTTTTCAAACTGGGAGTCCAAGGA
TCCCCAGCATTACTGTACCTGGCCTGAGTAGCTCCTTGAAATCAGAGACAGGGCCAACTCATAAACTGAC
CTCAGGCTGGGCCTGGGAATCTGCATCAGAAATAAGCCCCTCTGGGGGTTTCTTCTTTGTACTAAGATG
TGAGAACCACCCAATTAGAAGAACAGACTCCCCCAGAAGACCAAGGTCATGCCTTCTCCTCACTTGGTAA
CATCTACCCAAAGAGGAAAACCAATGGAGCCTATTTCCCTGAAAATCTTGGATGTTTGTGAAAAGGTAAA
TTGTAAGTTGACTTTCCAAAAGTCCGGCCATTCCAAGCTGCAATGTGAGCCACATTCCCAGTGGGCATGA
CCCATTGTCTTGAAGAACACTCATCTATGGGTGTTTATTTCATCAGTGGCAGAATTTGCATTCGCTGCAC
GCTTTGTGTTCTATTACTTGTGTATGATTTTGAGGTTTACTTGGAATTTTACTGTCTTACTTTC
ACCAACTAGAATTCACATCATTTTGGGTCTTCTCTGCTGGATAAACGTGAATCTACAGTATCTATATAAA
GCATAGAAGAATTGATTCTTAGCTATGGATTCCTGTGCTCTGACTTTAGTTGAAGTGATTAATGCCTGTA
TCTTTGAAGAACATGTGTGAGCATATTTTTTTTTTCTGGTATTGTGCTAGGTAGAGCCTTCATTATGTC
ACCATAAATTTCTTTTGGGTGTATGATTCTTGGGGGTGGGTACAGGTCCTAAGACTGAAGAAGTGTA
ATTGAAGTCTATACTTTATATATCTAAAATTATTAATTTATGAAAACCAAGAAAAGGAATAATTTTTGT
CTGAAGTTTTTGCAGACTTTTTGTTTTAATCTAAACAATTGTCTTTGAAAAAGGATGCAGTTCAGTGAGA -continued

| Sequences |
|---|
| ATTGCATCCTTTATTAGGAGGATTATAGGGAGAATTACTAATGCTATTATTTTATGGAAACTAACAGGAG |
| CAAAAAGCCTAGCAGTTACTATAAGTGGATTGGATTTCAAGATGCACATTACATATTTTACTACAGTTTA |
| CAAAGTGTGCTAATATTAAGGGGCCAAAAAGAGAAAAGGCCAAGAAAAGTAGATGACTGACATGAACATC |
| TGATCCTACTTGACCAAAGTTGACAAAATATTGATGCCACTGTTCAGTGTTTAAAAGTAAACATCCCCAT |
| TTCATCTCTAAAATTTAAATGCTTTTTGTGAGTTGTTTGTTTTTGAGATCCCATACTACCAGATCTTTA |
| GTAATTCTGGAAGAATGCAGTAAACGGTGAAAAGAATATTTTTGTAAAATGTTTGGTTAAGTAGGTGGTT |
| TTATTTTTAACCACCATAACCAAAGAGGTAGGGACTTCCAGACGCCAAAGGGATCATTTTAAGACCAAAG |
| TTWVGCTAATTTAACAGTTTTATTCTTTCATATTTTTTGTGAAAAAATGTTAAACCATTTTTCTTCCTAG |
| CTGAAAGAAGTCCAAGGTGGTAACTGTCACATGTTAAGTAATTTAATCAAAAGATGGGAAGCAGAGACCT |
| ATGTTTATGATAGAAATTAAGATATAATCTTGATCTTCATTGTTGAGCTGTGGTATATTAACATCTCGTA |
| CAGTTGAATTTTCTTTTGAGTGAAGACTCACTTTTTCCTCCTTTCAAAATAGAGTTTTCTTAGTAGAGC |
| CTGTCTTTGTGGTCAACAGGTATCTGAGGTTGATAAATGTAGAGGCTACATTTTATGATGCCAAACCACA |
| TGACATACCATAGAACATGATAAACTTTTTTTTTTTGACAAAACCTCTTATAGTAAGAATAAATCATATA |
| GAAGTACAAATAGCTGATGTTGAAATATGTAGTTTTCAGAACAACACATAGATGGATGACTAGGTAGGAA |
| AACAAAGGACTTTGGCCAAAAAGTATATATACATGTATATATATCAGGAAGTACAATCATAAATGGATAC |
| TTTGGAATAAAAGTAACAGCATTTGGGAGTCTGATTTACTTATCCTTTCAGAGGTGCATTATTAATCTAA |
| ATTTTTATTTTAAGCATTTGGCATATAGACAAAATTTCCTCCAGATTTATACGAATCAGCTATGTTTCAT |
| CTTACAGTACAGAGGACTCAATAAGGATGGTGAAGCTTCAGAAGAGAGCTAGCACATTCTTTTGTCATGG |
| GACGATGACTCTGACTCAGTGGATCAGCTCATCTACTGAATCTGTACTAATGGGGCTTTAGACTTGAAG |
| TCATATTTTTCTTTGCTGCTGAAGAATAGTTTGCATTCCACGTTCCATAACTTGGAGAAAGCAGGGCCT |
| TGGACTGATAGGGGTCTGAAAGATGGTCCCAGAAGCCTACAAATTAAGTAAAGACTAAAGACAAAATTGG |
| ATGTAGAGTGGAGTGGGCTTTATTCCTCAGTCTGAAGAAGGCATCCAGAGGGAGACAGGACAGCAGAGC |
| ATCGAGATGGCAGCAGCATTAGGAGATGTCTAAGATCCTACTCTTCCAAGTGTGGTTCACAGACCAGCAG |
| CCTAGACATCACTTGGGAACTTCTTAGAGATGCAGGGTCTCAGGTCCTACCCCAGAGCTTCTGAGTCAGA |
| ATCTGTGGTTTCCACATCTACAGGTGTGTGTATACACATAAAAGTGAGAAATGCTGGCCACCATCACCAA |
| CCATTGAATCCTGTGCATGTCTTTTAGGAAAAATGACAATCTGGGATAGATCCTGTAAGTGTCCCTTTCC |
| AGTGGCCTCACGGGTCCATAGCATTACATAGAATACTGCGTATTTCCTAGGTGTCCACAAGAGTGTTCTG |
| ACCCTTGAAAGAAATAGACTGGAATGAAAGAGAGATAGGAAAGAAATGATTATATGCCCTGTCCCCTCAA |
| GAATGTTTTTCATGGTAGCTTTGCAATCTGTATTGGCCTTACTGACCCCATTAAAGGAAGACAGCTTTTC |
| TGTTCCAGTTAAAAGACAGGAACTTTTACTCTTTCTATAGCTCCATTAGGTATTTGATTCTCTTGTAACA |
| CAGTTCAAATTCTATAGAAGAGTTTAGAACTTCTTCATGACCAAGGGGCTCTTGCAAGTGGTGGGTTGAG |
| ATTTGGGTGAGATGATGGTGCCTGAATATTGATAGCATCCTCCAAACTGAAGGTAATACCATTCTTGGGCCAG |
| TGTGCATCATTTTTCTAGTGGCTGAGTATCAGCTGCTTATGGCCAATTATGGCCGCAAAATGACAGGATT |
| AAAAATAGCTTGAAGATGATCCAGTCTTCGATAATATATTTAATGATGAACTTTCCTTGGGAAAGTGCAT |
| CTTTCTGCCTGCTAAGAATCACATGGCCCCTTTCAATAATTTATTTTGTGGAAAATACACGTTATTGCTT |
| TTGCAGTCATGTGCTGTTGAGTGATTACATTTGGGGACTTTTGTAAAATGTTATAGTTCACTCAGTTCTC |
| TTTTCTGTTTTAGGGCATTTGTTCTATTTAGTATCGGTCGAAAACATGTCTTTCTTCTGCGCATCCTGTT |
| ACTTGTAGCTGTGCTTTCTAGTGAGAACTGATTGATCTTTTTAGTAATCCTTGATTGACCTGGAACATTT |
| CAGATTGTTCAAATGTCATTAGGCCACACAGTGCACCAGGTAACAGAAAGCCACAGATTTTTTTTTTT |
| TTTAAGCCAAATCTCTTTGAGTTTCTCTTTATCTCTACTCCCAGTCCTAGTCAGCTTTTTGGAGGAATGA |
| TAAACCCACTCGTGAAGCAGGCATGTGGGTGCTATGTGTATTAATAGCAGTGTCTCCCACTCAGAGCACC |
| CCCACACCCACTTCCGAGGGCACCCATTGTGTCTTCACAAGAGTTTAGCAAAGCGATATTTCAGCAGAAG |
| TGTATTTGTGCTAGAAAACAACACTGTCTTTGTAGTATGCAAGTAAAAAGGCTTTTTTTTCCCCCCTCA |
| GAGATATATTGTATTTGAGGTTCAAAGGTTCTGTTAAACCTTTTTAAAGTAATCTAATATCACCTTATTC |
| AGGTATAGCGGTAACCTTGCGAGCTGGTCACCCTTTCCCCCAGCTATCATCAGGAGACCACTCAGAGAAC |
| TGACTCCGCTACGAAGCTTCTTTTTCATTCCTCTTGGTTTGATTCAAACCAAATCAGTGCTTGACCTCAC |
| AACAGGATTAACGATGAAAGTCAGCCAAGGACTGAGACAGTAATTCAACCAATGTGATTGCAAGTCTTCT |
| GTGTGCCCAGCCCTGGGTTAGATTGGGGGTCAGGGAGAAACGCTCCCCCCCTCTCCAGCCCTGGATACTC |
| TCATAGGCTGATGCTAGAGATGTCCACGTGAACTCAGAGTTGCCACGCAACCTGGTAAGCATGATTTTAA |
| ACTCTCAGATTTAGAGGGAGAAAGAAAAAGAAAAATAAAATAAAATAAAAAACTTAAGTATGTGCTATT |
| TTGCATAAACTTCCATCTTTGTCTGAAAAAGTTATTTCTAACCATATGGCTCTTCATGTGTGTATTAGGC |
| CTGATTTAACTAGGAGGAGAAATAGTTTTTTAAAAAGACTGTGTTACACGGACATACACTTAAGAGAACC |
| GAAAGGCAGGGGGAGTTCCCTTGTAAATATTTACCCTTTGGGCACTCCTTATACATATTACGAAGACTT |
| AATAAACACTAATCTGCAGTTTTTCAAGTATTTCATTAATTGTTTCAATAGAAGACAATCAAGGCTCTGA |
| TTAGGATGAGTAGAATAGATTGCTTTGAAGAAATATCTTTCTTAAATCCTTCTGGTATGCAGAAAAATAC |
| GAGTTGATCTGAACCAGAACAGAGGAGAGAGGAAAAAACAAAGCTTTTGTTTTGGTTTGGTTTTAGGTTC |
| TAGTAGTGTTCTGTTTATTAAGAGGCTTCTCTTCCAAAATGCAACTCATAGAAATTCCCGGCTCACTGGG |
| ACATGTGTGTTCCCGAAGTGCAGGTGTTTACTGTCTAACTTCTTTTATTCGTCGGCCCCTTCTTTAACTG |
| GAGGTTGTAATACTTTTGAAATCACAACATAGCTGTTTTCATTTTTAAAGTATTTTTTGTAGATCGCC |
| ACTTGTTCTGATCTGTGCTCACCTCTCTAGTGCCAGCATGATTTCTCTGCTCTTTATTTGCCAGACAAAA |
| GAGAAACCCAGCTGTCTTTCAGTGAGCATGATGCTGGAATGATTGTTTCTATCTCTCCAAAGCCATGTAG |
| AATTTCTCATCAGGACCACTCCCACCCCCGACCAGCGTCCCCCACCTGCCCATCACCCCAGCACAGGGAG |
| ACCTCCAAGGGGGAGCTCCTTGATACTCACCAACATGGGTAAGGTAGGACTGTGTCTACGCAAGAGCGTT |
| GTGTCTAGGAAACCAGCAAGAGGGAGCAGAGAAGGGGTGGGTCATAGCTAGAATATTATGACCCCTGCTC |
| CAGTCTTACTACAGGCAGCCGGCAAGGAAAAATTCTGTCGTTAGATCTGATGCTTTCCTTCCAGAGCTC |
| ATAAATTCCAGCCCTATGCAGGGGATAAGATAGAATCTGCTAGAAGAATTTGTACTAGCTCTGGTCTCTG |
| CAGTGTTAGAGGCGAGTGAGGGTTATGCTCTAGCCTAAGATAAAGTTTGACTAACTAAACTTAACTAAAA |
| TCACTTATACTAAAAACTGCTTTCCCAGATGCCCTCTTAAACACGGTAGAAAGGGAATGTCCCTGACCTG |
| CTGGGGTGGCCCTTTGTAGCAGTGCACCAAGAGCTCCTTGGGTGATTTTCTTACGTGATTGGCTAGATTC |
| TACGAGAAGTTCGCTGGTATTTCCATTCTGCTCCTTGTTTTGCCTTCAGACTTTCAGGGATGGAGCCAT |
| ATTCCATTTTTAGTTAATAATGAACTCTCTGGGGCTTCAACATAATGAGTCAGAGGCTTATGCCGGACTC |
| CACTCTCCTCTTTACTTCGTCCTGAAAGCAACCCAAGGACCCACAGTGTCAAGTGAAGCTTACATTTT |
| CCGAAGGAGATTTCACCATTGAGACCAATACTTCTTTCTTGTGATGGTTCGAATTACTACATTTTTTCT |

| Sequences |
|---|
| GTTTTTAACTGTCTTGTCTTAAGCTGCAAAAGAATATGGGGAGTTTATGACTTGGGGAATGCTTGGAAGA |
| CCAAACAAAGCATCAGTGTTGCAGGGTCTCTCTTCTTGATTTTATCCGACTCTTCCTCACCAGCACTAAA |
| GGTTTCTTCTGCTTTTACAGAACGATGAATGTCATATTCATGTATTGCCTTTGAAACTGAATTGCAGCCA |
| GATATTCCACCCAGCTGCATTAGAATTTTCAAAGCGAAAATACTTAGTCCTCTTAATTCAATGCCTTCTG |
| ACAATTAGGGTAGGAAAAAATTAATTACAAATTATATCACCATCTTTAGATATTGATTTTTTTATCTCTT |
| GGGGAAAAAAAGCAAGTCCATAAAGGATGCCAGGTGGCACCTCTAAGTCTAAATTTTTAGGACTACGTCC |
| TAGCCATTCTCTTTATGAATTCCTGCTGGCATTTCTCTCTCTCTCTCTCCCTTTCTCTTTCTCTCTCT |
| CTTTCTCTCTAACACTTAAAACTTTCAAAGGCAGTTTTGAGCTATTTTTAACAAAATTTTAAGTATAGTG |
| AGGCAGAGCCTCTTACTAAATATTAAAGTGACTGTATAAAAAGAAAACAATGGGAAGAGGTCTTAAGGAA |
| GACGAGCAATTGTTCGCTAATCTTAACTCCGAGTTCCTAGCAACCAGGGCAGTGGTGGGAGAATAAAGAT |
| CTTGTTATTTTGTAGCACATGCACACTACCCTTTTCCATTGAAAAAACATTTATTGGGGGTCTACCATGT |
| GCAGAGTTCTATGCCAGGTGTTTCATCTGTGGAAGAAAACCTCTGCCTCTAAGGAATTAGCCAACCAGTA |
| GTGAGACTGAGATGTGTAAATTGCTGTGATCCTTGACACACTTTAGTGGGCGGAACCATCTGGTCCAGCT |
| GGAAGAAGGGGATCTGGATGAGTTTTGGTGGGAGATATGGAGAGAGGGCATTTCAGGTAGCTGGATGGGC |
| CTGGAGGAGTCAGAGCAGGCAGGAATATGTGAGGCGTCCCTGGGGACTTGGAAAGAGTCTGACGAGATTG |
| GGGCATGGAGATTTCTTGTGAGAAAAGACTGGATCGTAAGTTGAGAGGTCTGTGTTGAATTTGGTCGATG |
| TTAATAGGTTCTTGAAAGGGTTCTGAGACAAGGTGGGGTATGTAGGCTGGTGGAAGATTGACAGTGGCTG |
| AGGTTGGATAGTGGGAGACCAAGGAAGAGGTTTGGACCAGGGCAGGGGGAGTGGGGATGTGGACCCCAAG |
| GACTGACAACAGATTGAACATGGGAAATGAGGGAGGGAAAGAAGCAAAGAATGCAAATTCCAAACCCAGG |
| ATAAGAAAAATGACCGTTTTGTGGGGTAAATGTGATGAAATTCATTTTGGACATTTTCATCTTGAGCTTC |
| CCATAGGGTATCCATCGGAAATGCCCAGGAGCAGTTGGTCTTCAGGATCTAGACCTGGAGAGAGACATTG |
| GGGCTGGAATACACCCTGCTTTTCCCCCAAACCCTGTCAACTCCCCCTTTTCTTCTTTTGTTTCCAAAA |
| ATGGTCCTAGCTGCTGCTGCTGATTCTGCCTTCTTTTATTAACCACTCTTTCTACACCACCTTTCCCCCA |
| AAGTCCTCTGTAGAGGTCTATGGATTGAATTAAGGTGATTAACTTGAAGTTTTACTGTTCAAAGCTTGGC |
| TCCCCACTACCAGTTTGCCTACTTAAAGATAACTCAACTGGAGTTAGATTACTGTTGTTTCAACATCCTA |
| GTAGTGTTCTCCGTTTGCAGATTCTTAGACAGTCCAGGAGTTCTCCTGCACTGGTACTTGCTGACTTAAT |
| AGCAGTTCTCCTAGTATATTGAACCCGCACCTAGCATAGTAGATAGTAGGTGCACACAATGATTGTTGAT |
| TGAATAAATGAATTAATAAAAGTGATAGGATAGAGGCCCTTTGGACATCAAACTCATCCTCTCCACTCAT |
| TATATAGAGTATATATGTTCCACTCTCTAATGTTCCACTGTAGGGACATATGTGTTCCCACTGACCCATC |
| CTATGGATTCTGTTAATATTCAGTAGAAGTGGACAAAGAAAACTACCTCAATGTTTTGATTTCATCCTTT |
| ATCATTGAATTGAAAAAGTAAGTCATTCATACCTGAAAAGAAATCTTCTAGATTTTGCTTGATCTTAAAC |
| ATTCAACTTTAATGAAAGTCCTCACTGCTAATATGAGAGATTAGCACATCTCTGATCACATTGTATCTGT |
| TTGTACAAAGGATACACGCACACAGTCAGACATATATGTGCATACTTGCTCTCATTTCTCGGGTTTGTG |
| TCTCCAGCCCTGTTCAGACAGTCAGAGCCTTGTCATCTAAACTTCTTCATTACCTCATCCTGAAAGAAAG |
| CAGGGCTTGTCCATGGTTCTCACAGTGGGGACAGAGTGGCTTTTCCTCTGTTATTAGTATTGTAACTCA |
| AATATAAAAGAACTATAGCATACAAGTCACAAGGATAAATGTCCCCTAGTTCTCCTCCCCTAAAAACAA |
| GTAGCCAATTGGAGATGGGGGTCAGTATAACTCGGTATGTCCAGAGCAGAGGGATGCTGGGATTTTATTT |
| CTCCAGACACTGGCCAATGGGAAGATTACTAGGAGTGGTATGGAGCAAACCACTGGGCTGACAGGTTTGG |
| GCTCCATCCTCTGTTCTGGTTGAAGCAAGCATCACAGCCTTTCTGTGGTTTTTAAGAACTGGTGGAATTT |
| GCATTTTGAGAATCCTTATTCCTTGGCATGAAGCAAACTCAAAAGCATCGTTGCTCATCATTTGTCATCT |
| GTTTGAAAAAGATTATGTGATTTGTGCACTTGTCATGAAGCTTGACCATACTTCTGGGGCTTACAGATGT |
| GAGTCCCTGTGAAAGAAACCACAAGCAAATTCTCTTTTCTCCCCTATCTTTACTTCTTCCCTCTCGTTTC |
| TTCAATGGCCATCTGTGCATTATGTTACCACTGCCAGACCCTCTTCAAGTGGCTTATCTATGAGTGAATT |
| CAGAAACTTCAAATTATAAAGGACACCCAGATAATTGGCCCGTTCTCCAGAGTATCTGTCCCCTGTGCTG |
| CTGCCAGATTCCTTCTTAATGAATACATCCAGTGACAGTGGGATTCTTGATCCTCCGGATCCGTGAGAAA |
| ATGAGCTTCCCTGCTTTGTAACAGCTTGCAGCTCTGGGGAAAAAAAATGACAGCCATTGCACAAGTTTC |
| CTTTGAATGTAGTTTTCTTTCCCATAAATGATACTTTGAGACTATACTTAAGGGGTTATTAGTTTTCTAT |
| TTCATGCTTGGCCTGTGTGTGATAATAACACAAGCTGTCACTGCAAATCAGCAGCTAAACACGCTCTGTC |
| TGGTTAATGCGAGCATTTCATATTTGGCTCAATTAAAAATTAACTGATGAAAGTACATGTCAAATGGAAT |
| TTGAAAATACCTTTTGTAGGGAAGATTGAAAGGGCATGGCCAATGAGTAAATTAGTGGTTTTCAAATGTG |
| AGGATTTTGGGGACATTTAATACGAGTTGGGACACTTGACTCTTCTCTCAAATCTCTCTACCTGTTTGAA |
| AAGGATGTTCCCATCCATATCATGAAGGGCTCGATTGCATCTGTGTGTTTACTGGAAAATAATTGTTGTG |
| TGTGTGTGTGTTTGCATGCGTGCTTGCTGGATCATACAGTTAAAGCAGATAGAACAGGGGATGGGGGA |
| CTCCTCTATCTCACACTTTGTTTTTTTCCATTGGCAGCATGCTATGGGCCAATGTGGGAGGTAGGAGCT |
| AGCTTAGAGTCTGCAGGCTGGAGATCATGAAACAGCAGCTGCAGGAGAGCCTGGGGAAGCTGGGAGCAA |
| AGAAACGCAACCACAGTAGGGGCATTTACTGGAGTTGGGGAAGTCTTCCCAGGAAAGGGAGCTGAAGCCT |
| GGAAGCTGAGCCAAAAGTAACCTAGGGCTGTGGTAAGAAGGAGCAGAGTGTGGCCAGCAGACAGGACATG |
| GAGAAGAGGGACCGGGGGCTCCAGAGCATGTGGGGAGTTGAAGGAACAGAGGAGTCCAGCCTGGCTGGAG |
| TGAGGGGTACAGGTAGGGTGGATTAGAAAGGTGGCCAATAGAGTTGTACCACTGTGTGTATGGGGGGGT |
| GGTGGTTATTTTAGAGAGGTCCCTCTCTATTTGCTCAGCTAGACAGGTGATATTAGTGACAGGTAGGATG |
| CTAGCTCAGTAAAGGTGATGTGTGATCTCAGTACCCAGACCAGGGATTGAATCCAGGCTGTTTCAATGAA |
| AGCACTGTAATCCTAACCACTAGACCACCAGGGAACTCCCAAGAAATTGATAGTTTTGTGCAATAATCAG |
| GACTGGAAAGGAGAGATTTCTGGGAAGATGTAGTGATTGACTGAATGCTTTCAAATCTTGCTCATTTCTT |
| TTTCAGTTACAGTGGTCTTTTTTTCTGTAGCCACTTTGAAAAGAATATGTTTGGTCATTGTTCTGGTTAT |
| ACACAAATTTTTTTTTAAGTTTCCCATTCTCTTAAATTAATACAGCCTGACTGAAAACTTGATTTTGTT |
| GGAATTCACATTGCAATAAATCTTCATTAAAAACCAGTTAATGAAGATTTATTTGAAGAAAGAACTCAAC |
| TATGAAAGACAGTTTTCACAGAATTTTTTCCTAGGTTAAAAAAAATTGCAACAGTAGTGTCTTGTTTTGA |
| TGGAGGATTTTAAAGTTTCCGAAGGAATTCTGGATCTTTTGACCCATTTGATTTTCAGAAAACTCTAGGC |
| AAGGCAGGTATTATATTCCCACTTCTCTCTGGCTTCCTCTTCCCACACCCTTTTTGTTATTTGTTTATCC |
| CCATGTGAAGAGAAAACCTAGACTAACAAAGCCACATGAGAGCCAGTAAGTCAAGAGGAGCGGGTGTTCA |
| GTGCCAGACCCGGAGTCCGGGAGATATTTCTTAATGCTGTGCTCCTTCTTGGGGCATGTTTTCATAAGGA |
| CACTAGATTCCTCAATAGAAACCTAATCAAGTTTATGCCTAATTTTAAAAAATAGTATCCCTAACTGCTT |
| TTTATCGCAAAGATTTTTCAGGAAAATTAAAATGTAATCTTGCATTTCAGGTTACTTTCTCTCCTTTGGT |
| TTAGCTTTTGAAATGTGTTTCATCTTAATGGTGGAGGGACATCTAACTTCGCCTTATGATGCACGTGGAT |
| GTGACTGTGAATTGATCAAACTGGGCACACTTGACCTTGAAACTCCTTCAAGGGGATGGTAGTGTCCTG |
| GGTAAGAGAGTTTGCTAAAACTCATGCGAGGGTTCTGGAAAACAGCTCCTTTCAGCAGGGTCAAGTGGA |
| ATTATATAAACATAAATGGCTGTTTCTGCCTAGGGATCTGTGTTTTTATTTACTTTAAAAATTGGAACTC |

Sequences

```
TGGGAGTTCCCTGGTGGCACAGCAGGTTAAGGATCCCATGTTGTCACTGCTGTGGTTGGCGTTCCATCCC
TGGCCCAGAAACTTCCACATGCCTCAAGCATGATCCAAAAGAAAAATTGAGCTCCTGTCTTTAGGTATCC
AATATAAATTTGGTGAGTGAAGTGTTTTTTGAACTGAAAAAATGGTGGCACTTTCATCTGTAGGATTTCC
CCAGTGTCTAAAGGACATATGGGTATACATTTGTTCAACTTTGTTCATTCAACAGATAATTGTAAGAGTG
CTGGAGCTATGGCAGAAACATGACAGCCGTGAACTGTCTCTTGTACCTCTCGTGAATCCAACATTGTGGA
GAAATCAGAACAGTAAACAGGCAAATAATTGACAATATAATATAGGGGCTACAACATAATAAAAACAAGG
GAATTCAATACAGGAGTGCTGATGGGGCAGTATTAACGTCTTACATTTGTTTTTTAAAACTATAGTTGAT
TTATTATGTCATGCCAATTTCTGCTGTACAGCAAAGTGACCCAGTCATACATATGCATACATTCCCTTTC
TTATATTATCTTCCACATGGTCTAGACCAAAAGACTGGATATAGTTCCCTGAGCTATACAGTAGGACCTC
ATTGCTTATCTTTATTTTATTTTATTTATTTTTTTGTCCCTTTAGGGCACACCATATGGAAGTTTC
CAGGCTAGGGGTGGAATCGGACATGTAGCCACCAGCCTACACCACAGCCACAGCGGTGCGAGATCCAAGC
AGTGTCTGCAACCTATACCACAGCTTATAGCAATGCCGGATCCTTAGCCCACTGAGCGAGGCCAGGGATT
GGACCTGCATCTCATGAATGCTACTCAGATTCGTTTCTGCTGAGCCACTACAGGAACTCCTCATTGCTCA
TCTTTATAGTCTTTTTTCTTTTTTGGCCACCCTGTGACATATGGAGCTCCTGGACCAGGGATCAGATCAA
GCTGCAGCCATGGCCTAAGCTGCTGCTGTGACAATGCCAGATCCCTAACCCGCTATGTCAGGCCAGGGAT
CCAACCTGCGTCCCAGTGCTCCCAAGATGCCACTGAAGCGGAACTTCTGTATTTGTTTTGGGTTCTTCC
AATACTATTGCTGTTTGCTCAGAGGAGTTTGAATGGATTTTTATTTTTATTTACTTACTTTTCTGGCCAC
ACTCATGGCACTTGAAAGTTCCTGGGCCAGGGATTGAACCTGCTGCAGTGATGACACTGGATCCTTAACT
CACTGAGCCACCAGGGAACTCCTGAATGGCTTTTTAAAAATTAACAACTTAAAACATAGTGTCCTACCTT
AAAATTTAAATATAGATTAGTATAATAAGGCCCGTACATCAGTTTAAAAATGGGCTACTGGGGTTCCCAT
TGTGGCTAAGTGGAAACGAATCTGACTAGTATCCATGAGGATGCAGGTTCGATCCCTGGCCTTGCTCAGT
GGGTTAATAAGGATCTGGCGTTGCCATGAGCTGTAGTGTAGGTTGCAGACTGGGCTTGGATCCTGTATTA
CTGTGGCTATGGTGTAGGCTGGCAGCTACAGCTCTGATTCGACTCCTAGCCTGGGAACTTCCATATGCCA
TGGGTGCAGCCCTAAAAAGACACATACACACAAAAAAAGGTCATTTCTTCTTGAACCACAAAAAGGCTAGC
ATGCTCACCATAGGATTAAAGATGACCTATTTTAGGCTAAAATGTTTGGAGCGCTTTCCCTATTATCCCG
GACCAATCCAACCATATTCCCCATGTCCATTTGCCACAACATTGGTCATTGGCCTCTGCTGCTGAAGTTA
GCAGAAAGGAAGGAAACTAGCAATAATTGAACCCCACTAGGTGCCAGATTTGGGGCTTAACACTTTATGG
ATAGAAGATTAGTTAACTCCAGTAACCTCCCCCTGAGGGTAGGAAGTGGAATTATAGACGAGGAAACAGA
GGTTCTGCAAAATCAAGTAACTTGGCCTGGCAAGAGGCAAAAGCAGATCCTTTTTCAGGCAATCCAAGTG
GTAACTGATGTCCTCTGAAACATCAAGAAATTTTTAAAAATTTAAAACACAAACCTATTAAAAGTAACAA
TTTGGTGCATGTGATGTTTTGGTTTCTTTTGTGTCTCTTTAGGAAGTCCATTAGCCTTCTTTATCTCAGT
AACTAGGAGGTAAAATCTCTTACAATGTGGACTTTAAAAGTTCTTTCCTAGTTTAAAAAAAAAGAGACAC
ACACAGAGAAACAAAATGCTTCTGTCTCTCCTCTTTGGCTCCAATAGTCTGTATAAATAGCCTTTGAAAA
ATAAGTCATAATCACTTCTTCACACCAAGACCAGACACCTGATTCAGAAACTCTCCCTGGGGTAAGTGTG
TGTGTGTGTGTGTGTGTTGGAATAACACACCCACAGTGCTTTCCCGATTCAAGAGAAATGATCTCACT
GTCCAATTGTTACCTGCCTAATGCCTTAATCAAAAGGTGGCAAAAGGTCTGCGGTTTTACCCCTGGTGTGA
TCCTCAGCCCTCACTGTTCTTATTTTAGGCATGACCTTAGTGTTTTTTCCAGAGTCCAGAGGTGGAATGA
CATGTTACTCAAGTTTACAAGATGATGATGTATCTGCTTTTATATTTAGCTGTAAATTTTATTCTACTCA
TAAACAAACCCACCTTCGGTAACCACGGTGCATCAAGGGACAGTTATTTCCATTCCCCTTGGTTTAATTT
GGATACATTTGGCCTAGAACAGCACAGTGTTTCCATAATAACATCTGAACAGGATGCTGTGTTGATCTGC
AGGGCTCAGGGAGTTTCAGCATGGGCCAGGAAACTACTTTCTTAAAAGGAACTTAAACATCAAATTCTGA
CAAGGTAGGAAACTCTTACTAGTCTCCTTACTAAACTCTCTTTTTTCCTTCCTGCAGTCTTGTTAATTGT
TATATCTCTTGGTGATTATTAAACACATATGGATGGAATATTTAATCTTAGGTTCATGTGCAGAGTTAAG
TAACTCAAATTCAGGTGGAAAAAATATTTTAAGGGATTTGTTTAATGAAGCATATACAAATTAAAAAATT
TCTTCCCAGCACAACATGTTATAACTTTTAGAGTGGAACTTCATGGTATTTCACAAGGAAGCAAAAAAGG
AAGGGGAATTTATTCAGGCAGACGGACAATAGTAACCTTTCATTAAATGAGACAGAGTTCAATACCAAAC
CCTGGCTTCTGTGTTTATTGAACTAAACACACCACCAGCTATGTCCCTTCTCTTTTACAGACCAGACCGC
TTTAAAAATATTGGTCCAAAAAACCCTAAACTGTTTAATTTATAAGATATAACCCAACAGTATAATATCT
GCAAGATTGCTTTATGTATTTTTTATAAATCCTTAAAATCCTAATGGCTTCAGGTAATTAGGATCTTTGC
TCTTTTTGATGGTTAAATATGTGACGACTGAGTTGTCTGGCTTGGTCTCAGGACAAGAGAAGGGTGGGTTT
GGGTTCTGTGCCCAGGATGGGCTCCCTGGTTTCCAGCGTAAAAGAAGGCCCCGCCCTTCCTCTGCCCCC
TCCCACTCACACACCCCTCCCTGGGATGATTCATAGTGTCCACATGGAAATGAAGAGGACCCATCTGTC
ACCAGTGTTGTCATTTGTGAATAAAAAGCCTTTATGGCTGCAAAGCCCATTAACGCCCTCAGAAATCTCT
GTTTAAGCAATTATGGTGATCCTCAACACATCTAGGAAGGAGGAAGTAATTCCACCCCTGCTATGCAGA
AGGATATTCATAAAGCTCACGTGCCGAAGGTCATACCCATTCCTCATTAGAGTTGGGCCATCATTCTTAA
CAGCTTTGCTTTAAAATACATAAACATATATAATATGAATGTGGGTGCATGTTTATCTGATAAACAAAAC
TGATATAACTAAAACTTGCAGTTTTGACCATTTTTTTTTTTTGTCTTTTTGCCTTTTCTAGGGCGGG
CTCCCACGCATAGGGAGGTTCCCAGGCTAGGGGTCTAAACGGAGCTGTAGCTGCCGGCCTACACCACAG
CCACAGCAACGTGGGATCCGAGCCGCCTCTGCGACCTCCACCACAGCTCACGGCAACGCCAGATCCTTAA
CCCACTGAGCAAGGCCAGGGACTGAACCCGCAACCTCATGGTTCCTAGTCGGATTCGTTAACCACTGAGC
GACCACAGGAACTCCTGACCATTTTAAGTGCATCTTAAGTTCAGTGACATTAAGCACATTCACAATGTT
GTATAGCCATGCTCACCATCCATGCCCAGAACTTTTCTGTCATTCCGAACTGAGACGCTGTACTCATTAA
ACAGCAACTGCCCTGTTGCCTCCCACCTACCTGCCACCCTCCAGGCCCCGGTAACCACTATTTTGTCTTC
TGTTTCTATG&ATTTGACTTCTCTTTGTATATCGTGTAAGTGGAATCGTACAATAATTGTCCTTTTATGT
CTGGCTTATTTCACTTAGTGTAACATTTTCAAGGTTCATCCATATTGTAGCAGGTGTGGGAATTTTATTT
CTTAAGGCTGAAGAGCTTTCTATCCAATTCAAAAAATCCACTTTCTCACAAGATTGGTTATCATGTCCCC
CAGCCAACAGAAACAGCAAATATAGTTCATTAGGACTGAGTTGGCAGAGGAGACCTGCAGATTGTTTTAA
AATTGATTTTCAAAGTCTGACTGCTGGGAGTTCCCGTTGTAGCTCAGCGTTCACGAACCCGACTGGTATC
TGTGAGGACAAAGATTCTGTCCTTGGCCTTGCCAGTGGGTTAAGGATCTGGCATTGCTATGAGCTGTGGT
GTAGGTCACAGATGCAACTTGGATCCTGCATTGCTCTGGCTGTGACATAGGTCAGCAGCTGCAGCTCTGA
TTGGACCCTTAGCCAGGGAACTTCCATATGCCACGGGTATGGCCTAAAAACAAAACAAAACAAAACAAA
ACAAATCTGATTGTCAGGAAGAAGTTAAAAATGCTATTAAGACTGGCTCAGGAACTGAAAAGCACAGCCC
TCTGAGGCACCTCTGTGTGGGGCAGACAGTAATGAAGATCTCAGCTGCCCTTGAGGTTATCAGCGGGTTG
TAAGCCTCGGACAGTCTTACTTTTTCCTAAGGATGTTGCTGAGTCATCAAGACAGGCCTGTTTTCCATAG
GAAGAGTTGAAGAGTTCAGAGAAAGCGGGTAATAAGTTTCAGAAATATCTTCATTCCAAATGGTCAAAAA
AAAGGTGTTTTTTTTTTTTTTTAAAGTTTAGGCTTCAGTCATCTGAAAAATCCACTTCAGTGAAATGAT
TCATTCCAGAGGGTGAACGAGAAGAAGCAAAGCAAGAGTAGTGTAAAATAAATAAATAAATAAAATAAA
```

-continued

Sequences

ATAGAACAAAAGACTGTCCGTGACCTTTACTTACCTGTTACATTCCATTTCTTCCCCTACCTCACTTTTT
TAAGTGGAGAATTTTTAGGAACTTGACCCAAGTGGATATGGATATTGTGATTTCAGGGGGATTTTTTCTG
TATTGCTCTCACCTAGATCTTCCTCTCAGTGCCTATGTTACATTGTTTGAATATTTAGAATAGTCATGTG
ACAGTGTGAGGAGCTACGTTACAGTGCATTAGCTCAGAGCATCTGACTCTGAATGTCAATTTGAAAACAT
CGTAACGTAAAGTGTGGTCCTTAGCTCATTCCATGTTCTCCATGCCTGCTAGGCATCTGGACACCATCTT
TGGCCTCGCGGAGGGCAGTCTCCTGGGGAGACAGAAACACAAATGAATATGACAATCCAGTGAGTTTTTT
CCTGAGAAATTTAAGGATGATTTCATAGAGGAAGAGCCATTTGGCCTGGGTCTTGAAGGATAGTTGCCCT
ATGGAGAAGGGGCAAGGCTACCATGTGCAAATCAGCAGTCGTGAGAATGATCCAGAGGGCAGCATAACCA
GAGAGAAGGAGTCCTGGGGTGAAATGAAGGAGCTGAAGCTGAGGGGACAGTCGAGGCTGACTCACTGGCC
CCAAGTGTCTCCCTAAGGATTTCAGATTTGATCTTCCACACAGTGGAGAGCCAGTGAGGGTTTCTAGCAG
GGTGGTGAGTGTGTGTGTGTGTGTGTGTGTGTGTGTGTTGGGGGGAGGGGAAGATGGGGCAG
GTGTCTTTCTTGGCACCTGCCCTGTACACCTGCCGCATCTTCCCACTGAGGTGGAACAATTGTGAAAGTC
ACTTCAAAAGTAGAATCAGTGAAGTCTGTAGGAGCTGAGGAATGTGGATATGATCTGCCCATCCCTGAAT
ACTCAGGGCTTAGCATGGGACAAGCACAGGATAGGTGCCCAGTGAATATCGGCCAAGTGACTGAATGTAT
GAGAGTGGCCTGTTCCGACCTATGAAGCAGTACCAGTGGCATTAAAGGGTGCCCAGCTGTACTTGGGATA
AACCAGGTGTTCGCAGGGCACCTGCTCTGTGCCAGACACTTTCTAAACGTTCTGTCTCCCTTAACACATT
TATCTCTATGACAGGGCAGGTGGGTGTGGTTTTATCCTTGTCTCGCAGATGGAGCTTGGAGAGGTGACTA
ATTACAGTTGCTTTGGTGGCAGAGCTGGGATTTGAACCCAGGCATCCCTGGAGCACTTGGTGTTCTTCGT
CACAGCGCTTTGTCACCTCCCTTCCCCTGGAGTTTCCAGAAAGCTGCTTTTATCAAGGCCTCAGAAATGA
TGACTCGGGGCAAACATAACCAGGGGCAGGATGCAGAGAAGCCTGTTTAGGAAACCATTTATCTCCCGTA
GACGTACCGTCTGAGATGACCTTAGTGAAATAACAATGCAATAATAACAGTGCTACAGTCTTTTCCCTGG
CATAAGAAACCACTTTTGTCATGAAAATGGAATTTCTCTGGGAAATCGTCCTAGAAAGAGATAGGCGGCT
GAAATAAAATAACAAAAAATGTGAAATAGTATCAAATTGTTTTCTGCGTGTTTTCCCTCCTCCCCCTGCC
TGCCCAGTAGTGTCATTTACTTTGTTCACTTAAAATGTACAGCCTGGGTCCCTCAGTCCCAAAGCAAGAG
AGGAGTGTGTACATCCAGAGAGGCCTGCGACACACCTGGCTAAAGGGAGAGGGGATCCATTAGGGTCCAT
TAGGGTCAGCATTGCTTTCAGGGTGGAAGCCTGTGGTTTTCTGGAATGAAGGGTGGTGTGTGGTTTCC
CCGGTGGCCCACGGGCTGGAATCTGAGCTCGGCGGCGTTCAGGTGTGTATGTCCTGGATCAGTACACCCC
CAACTGAAGCTGTGTTCTCAGGCCATAGGTCAGAATTGTCTAAAATAAACTCTTGTCATAACAAGGGAGG
TGGCAGCCAGATTACATCTCAGAGTTCCTCCATGCGTTCACTCCAGAGGACACCAATTTTCCTGTCCTTG
TGGGGAAGGATTCCATTTTTATACGGATTCTAACTAGGGGTCTGTCTTGCTCTCCCACCCTCACAAATGG
TGATACATGGTGGTGGCCATAGCAGCGTGGAGAGAGTGCAGCCTGGAAACCCAGCCAAGTTCTCATGGCT
CTGATTTTATACAAATTTGCTCAATAGAATGCAAATGATTTCATAGTAATGGGGACCCAGGGACAAGTGT
TCATCTGTGTTCAGCCCTCTCCTTGGGCTTTTGGCAGCAGCCACTTCAGAGATAAGGACAGATCTGCATA
GGGCCATTTAAAGACGGTTTGGGAAGGAATGGCTCACAGCACCACAGAGACCTCACCTGGCTTTTCAGCA
GCCCTCTGGCAGCCCGAGAACCAAGACTTCTGTGTTTTGAGAACAGAAAAGGTCAACATGGATGAACGCC
TTTTAAAGCCCTTTCTTCCTCTTCTTGTCCCGAAGATGTCCCATGATCACAGCATACATCCTAACACTTA
AGCATCCCACACAATGACTGGGCATTTGCTCACTACAAGGCAGGGTCCTAGTCACTGATTAAAGGCTCAT
GTGGGCCATCAAAGTGTGGAACCCAAACGCCGTATCCAAACCTAGTCCTGCACTGTCCAGTATGGTCAG
GGCATGTGGAATGTGCCTCGTCTGAATTGAGATGTGATTTGAGTGTAAATACACACCAAGTTTCAAAAAC
TTAGTATGAAAAGATGAATGCAAACTCTTCATTGATCATTTTCCTGTTAATTGCATGTTGAAATGATATT
TTGGATATATTGTTTGGAATGAAGTATATTCAATGTGGCTACTGGAAAATTGAGGATGACACATTATATT
TTTATTGGACGCACCTGGTCTAGACTGCTGACCCTTTATTACACAGCGTGGTCACCTTTTAATTCTCCTA
TTTGGATATTATTGTAGAGGAGGGTAGAAACATCTTTTCTTTTCCCACAGATGGGGTACGGTGTAGACAG
TTTCATGGCACATTGTGTAACCTCACAAAGTGTGTTCACACCAAGTTTATAGTTGATCCCACTGTCAGTC
CACTGAGGTAGAGAGGAAAGGCCTGGCCAACACTTTTATAGGTATTTTTCAAGTATAATTTCTATCACAG
GCCAATGCCTATAAGAAATAAACTCAAAATTACCCATGGAAATATTGACTTGTGTTTCTATACCAAAGAT
AATAGACTGGGATCCTATTTAGAAGCAAATATGTTCATGTCTTGTGTGTAAATAGACACAGCCATGTCCT
GTAGCCAAATATGAAGCATTCATGAAAGGTTGTGGCTGATGTGCACTGGAAAAATATGACTCCCATTGAA
TTTTTGGATCTGTCAGGTCACGGGGTAGGGGAGGGTTAGGGCATGTTGTCATGACAAGGGGATCTTTCCT
TTGTTTGAAAGTTAGCTATTGTCATGTCCAATTCCTGACAGCTCAAAACGAGGTTGATTGATCTCAACCT
GTCAGAAAGGCTCGAGGTTGAGTTTGGCCATCCAGGGGATGGAAGGATGGACATCCAAAGGAAGGAAGGA
CAAAGCAGAACCCTGGACTGAAGAGGCATGGGATCAGATCCAGGAATTTTACTCTCAGTGCTTCTGACAG
CAAACGTGTGAGGTTTTCTCACACCAACAAGCAATTCTGCCAATCCCTGGCCTCAACTCAGTCGGGTGTCCCTAT
ACTTGAATCAATGTGGATAGTAACTCCAGGTGGAGTCAGCATCAGATCCCATACATTAAGGGCTCAGTCC
CACAAGACTGCCCCCACTTTAGACACTACTCAAAAATCTCAGCCACCTACAGGTTCCTGTAACCCCTTCC
TCACGCTCGATAATTTGTTAGCACAGCTCACAGGACTCAAGAAGATTGCCTGGGAGTTCCCTTCATGGCT
CAGTGGTTAATTTGCACAACTAGGATCCAAGAGGATGCAGGTTTGATCCCTGGCCTCAACTCAGTGGGTT
AAGGATCCATTGTTGCCGGGAGCTGTCGTGTAGGTCGCAGACACAGCTCGGATCTGATGTCGCTGTGGCT
GTGCTGTAGGCCGGCAGCTGTAGCACTGATTCAACCCCAGCTGGGAACTTCCATATGCTGTGGATGAAA
CTCTAAAAGCAAAAAAAAAAAAAAAAAAAAAAAAAAAAGAAAGAAAGAAAGAAAGAAAGAAAGAGAAGA
AAGAAAGAAAGAAAGAAAGAAAGAAAGAAAGAAAGAAAGAAAGAAAGAAAGAAAGAAAGAAAGAAAGAAA
GAAAAAGATACTTTACTAACTCAGGAACAGCCAAATGGAAGAGACGCACAGGGGAAGAGGCCTGGTCCTT
CCTTGCCCTCTCTAACAGTGCCCCTGCCAGCACTTCAATACTTTCACCAACCTGATTGCCCCATAGTCTA
GGGGTTTTAATGGTAGTTTCATTATGTAGACGAAGTTGATGAAATCATTGGCCATTGTAGGAACTCAGTT
TCTAGCTCCCCCACTCTGATCAGTTCCAACCCCTGATCATGCCTTGCCTTCTGGTGACCAGCCTCCATCC
TGAAGTGACCTAGGGGCCCAGGCCCCAGTCATCTCACTAGCACACAAAAAATACTCATCACTGGATGTC
CCAAAGGTCTTGGAAGCCCTTGTTTCAGGAACCAGGAACTGTTACCACAGATGCGCCCTCACCCCATCAC
TCAGGAAGTGACAAGGATTTCAGGAGCTCAATTCCTTATTTATGCCACAAAGTCCCACACTCAAAACTGG
CAAAGAATGGAGAGTGCACTTCTAGAGCAATGAGAGAAGCTGTCAAGGCCAAGACCGGAGGTGGGTGCGG
CCGGTGAGATGAGCACAGCTCTGAGGGCACTAGAGCCAAAGGCCTTGGGTTGTATCCTCTTGGTTCTCCC
AGGAACCTACCATTTGGGCAAGCTGCACAGTTTTCTGAGCTTCAGTTTTTTCACCTGCAAACCAGGGAGT
TGTGTTAAAGTGTCTGTCACTAAAATTTTGTGATTCTGTGAGTTTGAAGACAGAGAATTGGCAGGTAT
AATATTAATGTTATCTATGATAGCATAGGGGTGTGCTTCTTACTGCTCTTCTCCTTTTGTCTAATATACT
GGGGGGCACTGAGATCCATGGTAAATATGATCATTGTTCTGGACCATTCATTTGGCCCTGAGTGAGACAG
GTGTTGAAGCCAGAATTCCCTTGCAGCTGTGGCCAGTACACACGTATTATAGCGTAATATCTGAAAACAT
GTATATGAATTTCTTTCTTGGCTTTCCCTTTTTTCCTCATCTGTATACTTTCTGTGATTTATAATTATTT
CATATCTTGAGAGTTTAATATTACACAGGTAGCAGTTTCTCCACATGGATCATAGGCTTTAGTAAATACA

-continued

Sequences

```
TGCTGTTCTTGTCTACAACTGTTTTCTCTACCCTCTCCTGCCTATGGACTAAAAAATTTCTGGGCCATAG
ATGAACACCATAAGAATTTAATTACACTTGTAAAATTTTTAAATAAGGACTTGCAAGATTTGTTATAAAA
CCAGGAATTCTCATTGTGGCGCAGCAGAAACGAATCCAACAAGGAACCGTGAGGTTGTGGGTTCTATCCC
TGGCCCTGCTCAGTGGGTAAGGATCCAGCATTGCATTGCTGTGACCTGTGGTGTAGGTCAAAGATGTGGC
TTGGATCTAGCATTGCTGCAACTGTGGCATAGGCTGGCAGCTACAGGTCTGTTTCAACCCCTAGCCTGGG
AACCTCCAATATGCCTCAGGTACAGCCCTAAAAAATACAAAAAAAAAAAAATTTGTTATAAAACCAAAGT
AGTCAAGACAATGTGTTATTGGTATAAGGACAGACACATAGATCAGTGAAAAAGAACAGAATCCAGAAAT
AGGTCCATGCATCTACAGTGACTTAATTTTTTAGACCTGTGCCAATGAAATTTAGTGGAGAGAGGAAAGT
CTTCTCAGTAAGTTTTTCTAGAGTATCCAGACATCTATACAAGAGGACAAAGTGAAGCTTGAACTCTAC
TTCATTCTATCTACACAATTAATTTAAAGTGGATCCTAGACCTATAAGTGAAAATTTAAACTATAAAGTT
TAAGAAAATACAGGAGAATATTTCCGTGATCTTGTGTTAGGCAGAGATTTCTTAGACAAGACACAAAATG
CACTAATAGTAAAAGGGAAAATAATGAATGAGAACTTCATCACATTTGAAGTACAAGTTATTTTAAGGTG
GCCCTGACAACTGATTTCAGTTTTTGACTATGTTTTTCTTTTTCTTTCTTTCTTGACTGTGCCTGA
GACATGTGGAAGTTCCTGGGCCAGGGATCGAACCCCCACCATAGCAGTGACCTTCTGTAGTGACAACTCT
GGATTCTTACCCTGCTGCACCACAGGAGAATTCCTACTTCTTTTTTAAGATGATATTTTAATGGCTTTA
GTAGGCATGGGGAGACAAAGGCCTTGGTTCTTAGATAGCTTTGTATCTTGTGGAGAATCACTCCAGGAGC
ACATGCCTCCATGGAGGGGCCCAGCCACCTCGCCTGCCTTGTTCTCCTCTGCTCAGCACCAAGAAGCCTG
GCATCGTTTTTGCGGGAATGAAAAGATTGGCAGAGCTGCCCTAGATGACAGCCCTGCAAAACACCATGGC
AGAAGGTTTGGTCTACATACCAAGGCAGCCAGCGTATTAATTGCATTCTCCGTGATCACAAAAAAGGCGC
TGAATTATTCTCTTCATGTTTTAAGAATGACAGGCTTTTGCTCTGCCAGCTCTAAGCATAGTGCTATCAC
ATGGAAAGGAGATGCTAGATGTGACTTAAAAAAAAAAAAAGTGTGGACGTGACGATCACTGGTAGGCAGG
CAGCTTGTTCTTAAAAAAGATCTAAAGTTGAACTGTTTCATAATCGGTACCTGCAAAAAGATTAGGAGCC
TGGTGAGGAAGTGTTTCATAAATTGACTTGAGCTATGAAAGCGTTTTCCATCTGAAATCTTACTTTAAAA
TTTGAAATGGGACTTTTCAAGTTGCCTTGCTTCTGTGAAGTCCCATTTTCCTTTATGTTTGTGCGTGGAC
TGGAGGAGAAGTGGTCCAGGTGATTTCTGTCCTTATCTTCCCCAAGGCTCTGTTCAAACACATTCATGAA
TGTTCTGAATATCCAGGTCCTGCAGACACACTGTGCCCTCACCTGCTGTCACTGTTTGAACCGGTTGTTC
CCTCTGCCAAGGGCATCCTGCCTTCAGAGCCCGTGCTCACACTCACTCCGCCCTGCACAGGCACGTTTTC
TTTCTGGTCACTCTCATCTCTGAACCTGGCAAGGCTATTTCGTTGGAGAGCTGTTTGTGATGATTGAACTT
GGTTGGGGGGAGAGTAGAGAAAGCAGGTGTCAGCCTGTGTCGTGGGGATTTTCCTATGCTGAAAATTGTT
ATTCTGTGCAGCACCCCACCCTCCCCTCTCAAGCCCCAAAAAAAGAGAAGTACGAAGGCTGCTGATGTTC
AAAGCTTGAGTATGTTTTGCTTTAAAATGTTCAGTAGATCAGAGGACATTTCATTCTGGGCAGTGAAGTC
TGGAGAAGTATTTTGATTTCCTATGATTAAACCTCGTCTTCCCTTCCTTCTCATCCTGGTGGCTCGAGTA
AGGTCTGACAGGAGGTGGGGGGAGACGGGCAGCCACGGATGGCCTGGCTTGGCTCTGATGGGGCGGGGG
GCTGGGTCCGGCCAGGGGCTGGGGCCAGTGGGTGCATATGTCACATGTTCACAGAAGGCTTGGAGCAGAG
CATGACTCCTCCAAACTTCCCCATCAGAGCGTACCCCCACCCAAAGGGAGATTCGAGCAGCCACCGGGTC
TTGGTGTGAGAGCCATTGTTGACATTCCTTGTCACCTGCAATAAGAGGGAGATGCCCAGGGCAAGAGGGT
CTTCTGTCTGTGGGCTGTTTGCCTGCTACAGGCGGTGCAGCTTGCTTTTCTTTTCTAGAGTGAGCTGTTA
AGTGAGTGCTTCACTCAGTAGAACTTCTGCAGGAGAAACATTTCCTGACCGTCCCTCCTACCACCAACA
CACACCTATTTCACTCAGTCGCAGAGAACTTTTAAGCCAGTCCTCCGTGGTGTATCTCGTGGCTGAGGAA
CCATTCATTCACTGAGGAAAATGGTCCTGTCTTTACCTTCTTTCAAAGACCATTCCATCTGCTGCCCATT
TACAGAGCACCTACTATGAACACCTGCCACACACACCTCAAACCCTTCTCCTTCTGCGTGTGAGCCCTTTA
TTATCTCTTTGTTATCAGACTGCAACTCCCAGCCTAGAATTGTACATGTAAGTGAAATATAGAACGTGCA
GTTAAAACATGCAGGTTACTTATAAAATACATTGCACAGTCTAGAAGGAACACCCTTCTCAAACTGTGTA
TTTTGTTTCAGTGTTCATCTTAATCTTTATTGCCATCCTTTCATATCTAAGATGACTATAAAATTTATTG
TCCAAGCTGGGATGCTTGTGAGAGTGAAAAGAGGTGCTACGAATTATAACTCTGGGATGTCAGGATAAAC
TGGGGTAGTCCCAGGCTAATTGGCACCCTATAGTAACACCTCTGGGCATATCCACCTTTTTGAAGGTTTGG
ACATGATTTTGGGTGTGGTGTGTGGGGGGGGGCGCTTGTGCTGAGTCCTTCCAGCATTTTTCTGAAAACC
AAATAAACCCCTTTGTAGGTTTCTGTGTCATGTTAAATCACCCCTGGAATTTATTCACAAGAACTACTTT
GGTTGATCTGTTAAGTCTTTTACTAGGTTTTGTCTGGACACTCCATTTCCACGCTCAGGATGTAGCCACC
TTGCATTTGCCCACTGCATCACTCTCCTGTGAGTTCAGCACTGCTTTAAAGGGGCTTCTAGCCTTCTTGG
ACTGTGACTGGACTTCTTTCCCATGGGATTTTTCTCCTATATGAATTTGCTTCTTTGTTTAGGAGTCTCA
GAATAGGAGGCAGAGACATAAGCTGGACTCTATGTCTAACTGTTTCAGTAAGGTTGTCTTCCATCTTTCT
GGTATGAGAAAGAAATGCACCTAAGGAGTCCTTTCAGCCGTTCTTTCTATTTTATTTTATTTATTTGTA
ATTATTATTATTGTTGTTATTTTGCTTTTTAGAGCTACACACATGGCATATGGAAGTTCTCAGACTAGGG
GTCGAATTAGACTATAGCTGATGGCCTATAGCAGCCATGGCAGCCAGATCGAAGCTGCCTCTATGACCT
ACACCACAGCTCACAGCAATGCTGGATCCCTAACCCACTGAGTGAGCCCAGGGATAGAACCTGCATCCTC
AGGAATCCTAGTCAGGTTCTTAACCCGCTGAGCCACAACGGAACTCCAGTTCTTTTCTATTTTATTGAG
GGAAAACAAAAGAGTACTCATGAGTACCCCAGCCTTGTTAGTGTGACAAAAAGCGTTCCAAATATACTAA
GTAGTTCTGAGGTTATTTGCTCACCTTTGTGCTATTGAATGTGCCTCAGCTTGCACTTCTATATGTTGGG
ATAGGAATTCCTTGCTTTAAATTGCAACCTCCAAGAGGATGGGAGCGCGTGTTTGTTTCACTTTCTGCGA
ATGATGCCGCCATGAGACTGTGAATCCATTGACACTTGATGAGTGTTGCTTTCTGGTGCTAAGTTTGAT
CTGTTGACAAGCATCAGGCCATATGTGACAGTGACTGCCCTAAACTAGGTAATGTTCCCATCAACTCGGT
TTTGTGAGTCTTTGATAAGAAGTTATGACTTTTTGAAAAAAGGTAGAATTTTTTGTAACCATGAACTTC
CATCTGCCCAGTCAAAATAATAATACATTTGGAGGACAATTTAGAGATTCTTTCAACAAATAAAGAAGAA
TAGAAACCAAGCAAATGTGCCCAAAGAATTTGGTACTGGAAGAAAATCGGCTTCATCTTACTAAGCAACT
CTTGTGAAAAGCTTATCCATTTTTTGCTTTTTTTGCACTTTTCAATCTGCAGCTCAGTTAGGCCACAGGA
AAAGGATGGTGTACCTTCAAAGAGCCGGTTGAGTTGGCCAGGTTCTTTGTATTCGTGGAAAACAGCTGTG
GGTGCTGAGGGTAAAGTCAGGCTTTTGTTCCATGCAAAGGTGGGAAGATTCAGTCTTGAGACGTCTCGT
TCTTCTGTGGAGGAGGAGTTGGCAGATGTTGAGCTGCTTTATCGACATCTTCAAGGCGTTTGAAATGTGT
TGATAATGACCTGGGAAAGAGACACGGGCGGGATGACAGTGGGAGTAGGAAAGAAACATTCGTCCTACAC
AGTACTCGCCTCTTCTCTTGTTTTTTTTGTCGGTGGTGTGGCTGCAGATTAAATGAATTAGGTTATTTGT
TTCCATTGCCTTCTACCAAATAGAAGTACTGGTATAAGCCCTCCATTATTTTTTCCTGACTATTGAAGC
ATAAATTAATTCTGTGAAAGGAGAGCTGTCCAGAGCAATGAGTTCTGCTCCCCTCCTCTCATGCTGTCTC
TCCTGTGAGATGCCAGCAACGGAGCTTCTCCAGAGCTTCGTTATAAAGGATTGCAACTACGTCCCTTATG
AGTGAGGGGTTGAGGTGTATGCCTCGCTTCAAGTTAAGATCAAGCTTTAGGTATTCTCTTTTGCTTTGAA
AAACGTGTTCGGGTGGGGGGGCGCATGTTGAGTAAATTGCTTGGAAGGTCCTTTGATGCTGCTAACCTG
ACACAGCTCTCTGTCTCTCTGTCCCTCTTTTCTTGCCTCTCTTGTGAGTGACCTCCATCCCCACAGCTTG
```

| Sequences |
|---|
| AATCTCACTTGTATTGAGCCACATCTCAGATGGGTATTGCCACCCACTCCAATTCTGCTTGTCTACTATT |
| TCCTGATGAACCTTTCCACCTGGATTTCCTGTTGGTTGCTCACATTTTACGTATAATTAAAATATTTAAT |
| TCAGGACTAAATTCATCATTGTTCCTCCAGTGCTTTCTTGGGCTCAATGATTTTCTTCATGTGACCACT |
| ATTCTCCTGGTCACCCAGGTTCAAAAAGGAGGCCGTGTCTTCCCAGCTTCTGCTCACTCAAGTCAGAGTT |
| CCTTCTTTCCCTCTTCATTTTGCACCCCTGACTCTTGTCTAGGCAATTTTCTTAACCCACTCCACTTTCT |
| CCTCACTCCAGTTTATCTTATGCTTTGTAACAGATTTGATTAAAATTCTTACCTGATTAAAAAAAGGCTC |
| CTCCTCTCCTGCAGGATAAAGGATGCTGCTCCTTAAGACCCTTCTAAGTGAATTTTCAATCCTTGCTACT |
| CTTGGACATGATTTGCTACTCTTTCAACCCACCCTGTCTTCTCTGCTCTGGGCATCATTTTTTTTCCTGC |
| TATTTTTACATTCCAGAGGCTCTGCTTCCATCCAAGTTTTCCAAAGTTCCCCATCCCTCAAGACTTAGAC |
| CTCCTGGAGGAAGATGTTCCTTCCTGTTTGACGTGACCCCTCTGACTTCTGTATCTCTGCCCCATCCAGC |
| CCTTGTTGTGACTCTCTTCAAAGCTTCATGACATGCTCTCTGATATGGCTTTCATATAAAATATTTGCTA |
| TCCTTTTCTTTCTCCCTTGCCAAGGTTCTAAACTTGTTTCTGTCTTCTGCTTTTCTGTATCTACAACTTT |
| GCCTATAAAATGGTCTTGCACCTGTTAGTGCTCAATGATACTTGCTGAATGAATTAATGAAGTATAGTGG |
| CTTTGCCATCTCTTATTTAAACCTGTTTACTTCTCTCCTTTCTTCATTCATTCCTGTGTGTGTGTATGTG |
| TGTGTGTGTGTTTTTTAGGACCATACCTGAGGCATATGGAAATTTCCAGGCTAGGGGTAGAATCAGAGCT |
| GCAGCTGCCACCCTATGCCACAGCTACAGCAACGCCAGATCCAACCCATGCCTGTGACCTACAGTGAAGC |
| TCACTGCAGTGCTGGATCCTTAACCCACTGAGTGGGGCCAGGGATTGAACCTGTGTCATCATGGATTCTA |
| GTTGGGTTGCTTATTGCTTAGCCACAACAGGAACTCCACTTCATTCATTCTTCCAATGATCATAAATTAA |
| GAACCTGCTCCAGTGCAAAGCGTGTGGATTCATCAGTGAGCAAACAAATCCCTGCCCAGAAGGTGCAG |
| CTTCTTTGGAAAGCAAACCATACTTGCTTCACCCTCTTGGAAAAAAAAAAACAACACACACACACAGGAA |
| GCAGTCATTTTAAATGTGATTAACTTTATATTGTGTTGTTCTGTGATTAAACTTGGCTTCCACGAAGACT |
| GTGCCTTTTGGTAGTTAGCAACTTTTGAGGATCTGTTTCTTAAAATTGGCTCCATAGCCCAGTGGCTAT |
| CAGATGTTGAAAACTCTACTTCTTTGACCTGCCTGATGGTGAAATCGAGTCATTTTGAAAATTGCTGTGA |
| AATAGTGACAAAGGTCTCTTAGATTTCAGTCCCCTCTGCAGCACTGAAACACTTGCTAGCTACTGCCGCT |
| TTACCAGCAATAGCCCGTGCTCATCTTCCTTTGTTTTTTTGATTGTTTGTTTTCTTGCTGTGTGTTATA |
| AAACAAAAGCAAAGTAAAGAGCAGTGCATTATATCCTGGCATCAATACAATGAAAAGCAACCATTTTT |
| CAAAGTTTAATTTCTATGTTACAGATAAGGAAGAAAAAATTGTTGTTGTGGATACATGAAGTACGGTCGT |
| GTTAATGGCGAACGTATTAATGAAGAGTGTGCCTAAAATCATATTTGGATGAGGAAAATTCTCTACTTGT |
| GATTTTGAATAACTGTCGATCACTCACTCACCAACTCTGAATTATCTAACGTGCTGTTTTCATGTAGGAC |
| TATAGTCATGAGTTCTTTTTTCTTGTAGCTGCAGTGAAACGGTATTTGTGGAAAGAGATTGCTTTCAATG |
| CCAAACCCAACAGTTTTGTTTTCAAATTCCTGAAAACTGAAAAAAGAAATCTTGGTGACATCAATGTTCC |
| AAATTCAAAATATCCAAAAGTAGACTCATGGACTTCCTCCTTGAACCCACTGTTCCGTGTCTGTTCTGTC |
| TGGTTAATGATAATCACCGTCCACTCAGACAAGGCCCAGTCCTTTAAATCACGTTCAGCTCAGTTTTCTT |
| ATCTGTGAGACAGAGCCTTTCCTGGAGGTAGATCTTAAGATTCTTTACAACTCTGAAAACCCGTACATCT |
| ATAGTATGTGATTCCTTCTTCACAATGCATCCTACACGTGTGAACCCCACCACTCAAATCTCTCTCACCA |
| AGTTTCCCCCCTTCTCTCTTTTTTTAATCTTGCTGCTACTGTAACGCAACTCATTACTTCTTTTTTTTTT |
| CATTTTTAAAAGTTTTCTTGAAGTTTAGTTGGTTTACAATATTTTGGTCATTTCTGCTGTACAGCAAAGT |
| GATTCAATTATATCCATTCTCTTTCAGATTCTTTTCCTGCATAGATTATCACAGAATATTGGGTAGGGTT |
| CCCTGTGCTATACAGCAGTTCCCTCTTGGCCAGTCATTCCATATGCCAACCACAGTGTACATATGCCAAC |
| CCCAACCTCCAGTCCATCCCTCCCCGAACCACCTGCCCCCTTTGGTAACCTTAAGTTTGTTTTCAAAGTC |
| TCAACTTCTCCATGACTTTTGACTATCCTGAAATCACTCAGCTGGTCTCCCTGTCTTTTTTTTAAATTAT |
| TTTTAAATTGACGTATGGTAAAATTCACATTCATGTACACTTTGGTGAACGTTGACACATGGAGACACAG |
| CCATCACCATAATCAGGATGCAGAACAGTTCCCTGACCCTCCCCCCAAAATATTCTCTCCTGTTGCCACT |
| TGTAGTCGAACCCTCCCCCAGACTTAGCCCCAGGCAACCTCTGCCTCTTCTCCGTCCCTTTTCCAAAATG |
| TCGTATAAATTGGTCTTCCTCTCTTTGAGCACCTGTTCCCAGCCCATGCCTTCTCTTTGTCAGTGCCATT |
| TCTTCTGGAAACATACCTCTTCTCTAGACCTTGAGAAATCCTTTCTTCTGAGTTTCCATTTCCTTGTTAG |
| TATGTGAATGGGTGAGAGTATAAAAATGATTACCCTGAAGAATTCTAATACTTTCTGCCAAAGCTGACTC |
| TTGAAGAAGACCCCTTGTTTTGCTGACTTGAGTGACTGAGGTGGAGATCAGAAAAGCAGTGAGTTGCTTG |
| AGTAAGAAGTGATGCCTGGAGCTCTCGAGGTAGAAAAAAGAGAGGGGCCAATGGGGCTGGTATCGGCAG |
| GGAAGTTGAGGGTGAGCGTCGTCATGGAGGGAGCCGGATGTTTCCCAGTGCCCTCAGGACCCCTGTATTA |
| GAGATCTCCATTCCTTCAGGTCCCACAGCACCATGGGGTGCTCTTTGAATGGGGCTTTGTATTGAGAAGG |
| GCATCGGGAGACTCAGATCTGCAATGGGAACAATACCGTCTACACTGCCAGGCAATTGAAGGTGTCATAA |
| AGGAGTGCACCGGAGCTGAGCATGGCAGAGTCTGGATGCTAAGGAGGACGTGGACCCTCTTCTTATCATC |
| CTGTGGTGTCTCTAGCCTCTCCTTTTTCGTCCTGCCAAATTGCCCCCAAGCTTAACTCTTTAGCTTCGTC |
| TTCAGGGGCCTCCTGGGCTGGCCTTGTGGACACCAGGTCTCCTGACAGCTCACCTCTCCCTTCTCTGCTT |
| CCTGCCCGCTCCCACCCACCTCGCCCCATCTCATGCTCCAACTGCGTTCAAGTCCACTTTGATGAATCCT |
| CTCTCCCCTTCGATCCAAATTAATCTCTCCTTTGTCTGCGGTCTCTCTGTTTATATAAAGTACACAGG |
| TTTCATATCATAATTATTCATCTTTGACTCTCTCCTCCCCCTTGAGCTGTATAAAAGGTTTTCAATTCGT |
| AGTTGATAAAATGAAATTAATTCCTAAATTATCACAGTAACTTTGAGACTAGGGAAAGGAAGGCAAGGCA |
| TTCACCGATGTCATGCTCCCATTTTTTATGTACAAGTAGCAGGCCTGCGACCGGGCAGGCTGTTCTTTTA |
| CAGATTTCCTTCAGTTGTGAAATACATCAGGCGGTCCATTTTCAACGTCTGTTTCATACGGTCAGAGCGC |
| CTTAGGTGACTCATTTATGTGCATAAGATTAGGAGACAGTCCAGGTAGACCCAGAGAGTAAGGGCCAGGC |
| AGGCTGCTGCTGCAGAAAGTTTGGGGACATGGCCCTCTTATGGCTGTGGGAACCTGATACCACGCCCCCC |
| CATCTCCATTCCCATCAGTTCATTGCTGTGCTGTCAAGTTTAAGTTCCAAAGGTAGGCAGGGACATTCTT |
| GCTGAGTAAGGTGAGTAGATGACCTTCCAGTATCTTCCAAGTGCATCCTGAGATGCAGGCACAGACTCCT |
| GCTCTCCATGTGAACTGCTACCAGTGCGGCTGACTGTGAAACCCAAGCTCAGGATCCTGTTCCTGGGTTA |
| GAGCCGAAGCACATGGCTGACATATGTTCAATCTGCAGCCCACACAAGCCTCTAGAATGCTTCTCCCATC |
| TAGGACCTCACCAGCAATTACCATCCTGTGTTTGGATACGTTCTCTTTCAGAGATTGGGGCAGGATGC |
| AGTCTGCCTCTTTCTCCCTACCCAGGTCAGCCCTGACGAGAGAACCCTGCATCCTTGGGGAGACATCAGG |
| GGAATCACAAGGGCCTCTTCCCCTACCCCCAGGGCTCGGTTCCAGAGGTCAGTTGGAGAGCAGGCAGCAA |
| GGACAGAGCGCCCCCTCCCCAGCCCATCTCCAGGGTGATGGTCTCCAGCAGCAAACAACCCTCCTTCCT |
| TGCCAGGGGAGCCGAGTACACACGGGTCTTGGATGAGTGAGAAGTTCCCCCAATGATCTTTATTTTTCCA |
| TTAAGAAAATCAAATCCCTGTTCCAGCTTCCTGACCTTCAGCAGCTCCACATACGCCCCTGGGGTCTCTG |
| GGGTGGTAAAGCTACAGGTTAGCCAGTCGTGGTGGGTCCTGCAAGGCAAGAGAGGTGCGGCAAGACCCTG |
| CTCCTTGGGGATGCGCTGCAGCCTGCTGCCGGAAACACCTTTCTCTTTTTTCCCTTCACTCGCTGGAGT |
| GAAGCCTGATAGGAGCCAGTCCTGTCTCCTTCCAGGATTCTCATAGTCTGGAGCCAGAGCTGTTAAGCCT |
| GAACTGAGCTGGGAGTGGGCGAGGTGGGGGGATAGTTTTGAGGAAAAACCCACATCTCCCCTCCTCAAGC |

-continued

| Sequences |
|---|
| CAGAATACACTGCAACCAAAAATTTAATCAAGTTGCCCCTGTGCCGTTTTACAATAAGATGCTCAAACAA |
| CTGAGAAAGCAGAGTTCCCTGCTCTGCAATGTTATGACCTTGAATCACGGATTTGAAGCTGCCTCTTTTG |
| GATTAGAAATTTCAAATAGTGGACTCATTTAACTTTCCCTGTTCAGCGCTGGGAGCCCTGCCGTGTATG |
| CATTGCAGAGGCTGTGTCTGGTCTAGGCATGTGGTGGGGGGGCAGGGCCACCTGAGCGAAGACCACTCTT |
| ATTGTGTATGATCCTTGCAAAGGGTCTGAACACTTTGGGTACAACTCAAACCCTAGGAATGTCCACCTCT |
| GGGGCCCCAAATCGGGAAGACTGATAGGCACAACATTTGGGTTCTGGCTGGAGAGCCCTGCAGGACTATT |
| TGTGACCCCGACCTTCCCACCCCCGACCCCCACCCCCCACCCACCCTGGTTTGGAGGATTCTTGGCCTT |
| CTCCTTGGGGAGGAAACTGGCTGATTACGGAGACCCTGCTCTTCCTAGCAGCACCAGCCCCTCAGCTCAG |
| CCCCGACCTCACTCATCTCCTAGGATTTTAGGGAGGTCTGCACCCAGAGGGCACTCCCATTGGTCCACAC |
| AGCAGCTTATTTTTAAATGGCCTGGGGTGTCTTGAGCACATTTTGGTTGCTATAGACTAAATGTTTGTT |
| TCTCCCCCTCAAATTCATATGTTGATCCCTACCCCCTAGTGTGAGATGTTAGGAGGTGGGGCCTTGGGGA |
| AGTGATGCGTTCTTGAAGGAGGAGCCCTCATGCGTAGGGTTAGTGCTCTTACAAAAGAGACCCCACAACC |
| CCACAGAGCTCCCTTGCTCCTTTCCACACGTGCAGACACAGAAGACAACTGTCTCTGCGCCAAGAAATTG |
| GCTCTCCCCAGATGCTGAATTTGCTGGCTCCTTGATCTTGGACTTCCCAGCCTGCAGAACTGTGAGAAAT |
| AAAGTCCTCTTGTTTATAAACTGCCCAATCCATGGTATTCTGTAATAGCAGCCTGGCAGTCCGAGACACA |
| AGGGTTCTCAACCTTGGCTGCACATTAAAATCACCCAGGGAACATTTAAAATGCCAACATCCGGTGCCAC |
| TTCTCAGACCAGTTTCATCACAATGTGGGATGGGGGTGAGGGTGAGAGAGGGGACTGGAAGATGGGACCC |
| AGGAATCTGTGCATTTTAATGCCCCTCAGATGCTCCCGCAGGCAAGGCTGAACCATCACATTCAACAGAG |
| CACTCAGTGGACATCCATACCCTTTCGGCTGACCTGCTCTAGTTAGGGCGACAAGAGCTGGGTTCTGGTT |
| GCCCAGGAAAGTAAGGCTTTTCTGTCATTGCAGTCTGAAGTCAGATTTTCCACTGGAATAGGAAACAAAC |
| GCCAAGTTTATTTTAAACATTCTCTTGATCTACCTAAAACTAGGAAGTATAAAGGATCCTGTGGGAGCAG |
| TTCATTCTCACATTTAAATGCGTTCTTGTTTCCTCTGAATCAAGCCTTATGGTTTTATCCATTACCAAAG |
| GGGCCCTGTGACTTCCTAGGACTATAGTTGAACTGAAAATTCTGGGGCCGTGCATAGGGTGACTGGGAAA |
| GTGATTGAAACAGTTTTTTTTTCACCAGACAGTGAACGGTAATTTGGTCCCTGTAACTGGCACTCTTTTC |
| TGTCCTGTTTCTAGATGGGTCATGTGTGTCTCATAGGCAAAGGATTGTTCCTGGCTGATTATGTCCAGTG |
| ATTGTTTGTTTAAAACTTTAAAAGAAGAAGAGCAGATACACTACATTGGCACTCAATTAACCACGAAAAC |
| ATTTTTAGGTTAAGAAAATAAACAACTGAATTGGTGGTTTGTTTTATTACCAAACTAGTATAGTTGCAAA |
| GGCAGGAAGGAGTCTAGGTCTCTGACTGGAAAAGGTTAATAAGTATTCTAGTCAAGGAAGACTGAAAACT |
| CAAAAAGCTTTACTATTGGTTGAATTTCACTGAAATTAGAAAGTGACTCTTTTGATAGCCAGCAACTACA |
| GACTTTTGCTGGTGATGTGGAATGTCTTTAATTCTGAGAGATGGGCTTTTCAGAACTCTGCACATGGCAT |
| TTGCTTTGGCATTTGGCATTTTGGGGTGCCATATTTATTGCTTTCAGGTCCTATGGCTGTAGTTTTCTGC |
| TCTAATTACCCAAAAGGCAAGAAAAAAAGTAACTTGAATAGAAAAAAAGGGAGGGGAAATATGTTTTGAA |
| AGTTTCATTAATTGCAAAATGAAGTTAAATGGAGCGTTCGATCAAAGTACTTCTCAGAACCGATGGAGGG |
| TTTCTCAGAAAGAGCCCATTAGAGCCGGATCCTCTAAAGCAGTGGAAATCCCAGGAACAAAAGCCAAATG |
| CCTAGGAATTGAGTTACAGAAGAATTTCTGAATTGGTGCAGCTTGGTAATTTACAAAATAGAATGGAATC |
| ACTGACTGTTCTAAAATCTGTTCAGTTAAAATGGGATAATACATTTAGCTTACATGAACCATGCACGTTC |
| AACTCTTGCTATTATATTTTTTAACTGCCATTTATTAAGCATTTTTCTGTGAGCTAGGCCTGTGTTTTGA |
| CATTCTTGATCTTACTTTTGACGATTACAAAGATTCAGTGCCTTTCACAGAAGTCATTATTACATTGTGG |
| AAGGGTCCCAATGCTGACTCCTTGGTGTTTGGAGTAAATAAAATCTGCAATGTTATTCTGTAAAATGACA |
| TCTGAAATTTTATTTATTTATATATTTATTTACTTATTTATTGTCTTATTAGGGCCGCACCTGCAG |
| CATATGGAGTTCCCAGGCCAGGAGTTAACTTGGAGCTACAGGTTCTGGCCTATGCCATAGCCACAGCAA |
| CGCAGGATCATAGCTTACAGCAATGCTGGATCCTTAACCTACTGAGCGAGGCCAGGGATTGAACCTCCGT |
| CCTCATGGATACTAGTCAGGTTCATTACTGCCGAGCCATAATGGGAACTCCTGAAATATCATTTAGATGT |
| ATGTGAAAGCTAACCTTGAAAATAAGATTTCCATTCTATTGAAGTGCCTTAAAAATTGGACCTCCATTCA |
| GGAGGAAAAAAGAAAAAAAGAAATCAGGCCCACTTTCTCGCATAAACCGTGGGTTAAACTGGGTGTTTGG |
| GCAGATTATTTTGGGCCACTCTAGGCTATTGCATGCAAATCTAGACTCCTGGAAGATTGGAAGCCGTTCT |
| GATAATCTTCCAGGGTTAATTCTGATCCTTGGCCATGAGAGAAATAGCTGCTGGCTGCATCTCATAGGT |
| TGGAATTGCAGTTTAAAGATGATCAGAATTGCAGTTAAACATCATCGAAGGGTGACCTGGAGCTTAACTT |
| TCTTAATTAGGCATTTCGATAACTTGGGATACCAACCCTAACTGATATGAGTGATTAAGTCAGGTAATAT |
| CAATGCCCTTCCACTCAACTATAATCTTTAATTTACCTGATCAGCATTGAGCTCCCTTAGGCTAATGAAG |
| TCTGCAGTCAAAGTACATACAGACTCTTTAGTAAATCTGATTGCATTAATTACTGCTATGGACTGATTTT |
| AGTTCTTCTTTACTGTAAGAAATTCCTGTTGCTATTTATGTTGAGTACTAGATGGAATTAAAAAAAAAAT |
| GAAACTACCAGCAGCCAAACATATTACTGTGAACCCATGTGGATATGTTGTCTTCTCTCCCTTGTGAATA |
| TATTAAAATTAACTTCTCTGGCTTGGGTATGTATCTTGCAATAACGACTGCTGCCATTTTTTTTTCATT |
| TGCCCAAACAGAACCTCCTAACCCATTAAACACTAACTTCCATCCTCCTCTCTCTTCCAATCCCAGTGA |
| CCACATTCTGTTTTTTTGTTTGTTTGTTTGTTTGTCTCTTATGAATTGACTCTTCTAGGTCCTGTT |
| TATAAATGGAATTATATTTGCGACTGGCTTATTTTACTTAGCATGTCTTCAAGGTTCATCCAGGTTATAC |
| ATGTGTCAGAATTTCCTTCCCTTTTAAGGCTGAATAATATCCCATTGTCTATGTAGCCCACATTTCTGTT |
| GGGTACCAATCAAGTGCTCGAATTGAAAATGTAGTGCCAACAGTTTTCCTAAATGTATCAGTTTATGTTC |
| CCACCAGCTGTGTATGGGAGTTCATCATATTTTGCATACTCTCCAAATTCAGAATTGTCTCTTCATTTTA |
| GCCAATCCAGTGTGTTCGTAAAGGTATCACAGTTTCGGCTTTTTTGGTTTTGTTTTGCTTTTTGCATTT |
| CTCTAGCAGATACTGATTACTAATTGCTTTTCATATGTTTCTGTTTTTTTATTCATTTTAAAAATTTTAT |
| TGAAATGTAGTTGATTTACAATGTGGTGATAATTTCTGCTGTACAGCAAAATGATTCAGTTTTCACATGT |
| TCCTTGATTCTCCTTTGTTGAGTTGCCTGTTCCCGTCTCTTGCCTTGTTGCCTGTCTTTTCTTGTGGAT |
| TTGTAGGCATTCTTTATATCTCATGTACTAAATCTCTCACTACTCATGTGGGTTACAAATATTTTTCCCC |
| CTCTCTGTGACTTACCCTTTAACCCTCTAACAGCATCTTTTGATGTAAAGAAGTCCTTAGGTTTTTTTTT |
| TTTTCTTTTTCTTTTTTTGAAAGTTCCCAGACCAGGGATCACCACGGCCACAGCAACACCCATATCTGA |
| GCCACACCTTTGACCTATACCACAGCTTATGGCAACTATAAATCCTTAACCCCTGAGCAAGGCTAGGAAT |
| CGATCCTGCATCCTCAGGGATACTAGTTGGGTTCTTAACCTGCTGAGCTATCACAGGAACTCCAAGAAGT |
| TCTTAGTTTTAATGTAGCCTTACTGATCACTCTTTTCCTTTATCATGAGTGCTTATTGTGTCCTGCTCAG |
| GAAGATTTTTATCTAACATTAACTCCTAAAAGTTGTATTGTTTTGCCACTCACATTTACCTTTATATCGT |
| GCACTTGGGATTGAGTTATGTGAGTGTTTTGAATTGGGAGGGCAAAGTTTTCTTTTTTCCCACATGGTGA |
| GCTAATCAACTCAGCCCCATTTACTGGGGAAAATATTTTTTTCTAATGCTCTCCTGTGTCAGTGAACAAT |
| GAAGTATAAAATTGAGTGTTGGGAGCTCCCATTGTGGCGCAGCAGAATGAATCTGATTAGTATCCATGA |
| GGATGTGAGTTGAATCCCAGGCCTCTCTCAGTGGGTTAAAGATCTTGGGTTGCCGTGAGCTTCTGTGTAA |
| ATCAAAGACAAGGCTTGGATCTGGTGTTGCTGTGGCTGTGGTGGAGGCTGGCAGCTGTAGCTCCGATTCG |
| ACCCCTAGCCTGGGAACCTCCATATGCTGCAGGTGTGGCCCTAAAAAAAAGCAAAACAAAAAAATTGAA |

-continued

Sequences

```
TATTGAACAGTGGTCAAGTCTATAAAGGAAAAAGGAGAGTAAAGAGATGGTGGGAGGGCATGGAGGAAGG
TTGCCCTTCAGGTGTCTGAGAGACACGCCTTCTGGGGAGGCCGAGGTGAAGTTCTCGGGCAGGAGCAGAG
CACCTTTGCAGCCTGGCAGAAGGGCTGAGTGAGGGGAGAGGTGTTGAGAAGTAGCCCTGGCCAGAGCCAA
ACGCTGTTTTTCATAATAGATATTTCACAACACTCCCTTTACTCTCCTGCAGTGAAATTTGTGGAAAACA
CAACCTGTGTGCCCACAGAAACTACAAACCATCAATAGAATGCCTTAACCATACTGTAAAGTAACAAAAG
CAGAGTCAATTATAATAAGTATCTCAACACATCAGCATCAGCGTAGGCGTGACCACACAGAAGCTCCAGA
TGGTGTGGTCACGTGTTTTGCACGCCCTTGTAGGATCCTGGGAATGTGGCAGCAATAAAGACAGGTGGCT
GCAGATGTGCTACATCCTGATATAATGACAGTCAGTGTCACCATTAGCGATGTGATGTTTCTGATATGGT
GACTACTTCTTAGTCAAGTTCTAAACAAAACAAAGTACATCGTTCCCTGTTGCATTCCTAGAAGCTGGGT
TTTCACAGAAATTATGGAGAAAACACTTTGTGTTGACTTGCAAAACGGCAGCATTGGGAACCTCCAATGG
GTGATGGAGAGTCTCAGGGGATGTGGGGCATTTCTGGGCTGTGTGGGACCATCCCAGGAATTTGAAGTTG
TCCCCCCTCCGAGCTAGGACCGCAATTGTCGTGTGGATCCTGGAATGGTCCCCACAGATTCCCCTACCAC
TCCCAAGGGTGCTTCTGCTCCCACTGGGAACCACGATAGGGCCCGGCAGATCCTGGCGAGGATGATTTAG
GGGTTTGTTCTGTGTGGATGGGAAGCCCGTGGACAGCTTTGAGCATGGAAGTGAGGTGATCTGGGTTTCA
AAGGAATCTCCTGGCCACACACACAGAGAAGTGGAGACTGAGATTTCAGAGTCTCTCAGCAAGAGCCCAC
CCCCACCCCCCTCAGAGCTGCAGGGGTGTGGGCTGACCTCAGTCTTTCCCCTCCTAGAGTCTCCTGCCTG
TCACCCATCACAGGGCCTAGTGAGCACCCCAGCAGAGCTCTGCTGTCCATTGCAGAGGGGCTTCCCCGTG
GGGGTCCTTTTAGCCCCAAACCCTCCATAAGTACAGGTGTTGGCTGTCACCTCAAGCAGCTTTCAGCAGC
AGCATCCTCCCACACACATCCATAATCTGTTTTTACTCCGCTTCCTACAGTAAAGATCAGATGCATGCGA
AGGGGTTGGAAGTAGCTTTGTAGATGAACTTCACACTTGGGTTATTTTGCCAGGCAACCTCTCCCTCCCA
GCCTGACCCCCTCCGGTGCACATGTACCCCCTTGGCTGGGCTGCCATTTGCTCCAGGGTTTGCTTTAGGC
CTGGGAGCGCAGAAGCATTTCCTGAAACTGGAATCCCTGTGCCCAGCCCACCAGATAATAGATAGATAA
TTGGGTAAGTCCTAAACTGGAAACTGCAAACAACAACAGAGAAAATGACATGTAATGCAGGGTGTGCACT
TTTCTCCAAGCGGGGCCGTTTGTGTGTGAAACTACTTAAAACCAGTCCTTTATTTCTCAACAATGGAACT
CGTTCGGTCATGAAACCCAGGGCACTCTCAAAGATTGTGGTAGAGAAGTCAGGGCTGTATAGTATAACGC
CGGAATGAAAGGGCATGTTCCAAGGTCTCTTCCACCTTGTGGCCCTGATGGGTTTTGTGTTGTCGGGAAG
AAGGGCAGTAAGGGTAATGCCCCTTGGAACTTGACATGTTTGGGTGCAGGTGGGGCAGGGTGCCCGCATG
TGTGATAATGAAATCTAACATTACTGAATATGGCCTCAGTAACTTCATGGTCTTCAGGACACCCAAACTT
TGGCCATTGCAATTATTCCCTCATTCTCTGATATAAAAGGATATTGGAGTAAAAGAAAGAACGTGTAGAC
CATAATAGCTGAATAAATACTTCCTTGGGAGTTCTCATCATGGCGCAACGGTTAACAAATCTGACTAGGA
ACCATGAGGTTGCAGGTTCCTCCTCGGTCAAGGATCCGGTGTTGCCATGAGCTGTGGTGTAGGTCACAGA
CGCAGCTTGGATCCCACGTTGCTGCGGCTCTGGCATAGGCTGGTGGCTACAGCTCATTTTGGACCCCTAG
CCTGGGAACCTCCATATGCCGTGGGAGCAGCCCTAGAAATGACAAAAAGACAAAACAAACAAAAAAATGC
TTCCTTGATTTGGATTGGCATATGCACACTGTGGTATGTGAAATGACTGTCTGATGGGGACTGCTCTCTA
GCACAGGGAACTGTACCCAATATTCTGTGATAATCTGTATGGGGAAAGATACTGAAAAAGAATGGATGTG
TATGTTTGTATAACTTAATTACTTTGTTGTACAGTGGAAATTATCACAACACGGTAAATCAACTATACGT
CAATAAAAATTTAAAAAATGAAAAAAGAAAAAAAACTTCCTTGAGACCCCCACACAGACTCATGGAGGCA
GAACCTGTTTCTGTTTTTGAGTATGGGGGTGAACAAATGTTTGGGTTCTAGAATAGCAGGATATGCTCTT
TACAGCCTGGGCATAGCTGGGCTTAGAATTTCCTGTTTAGAAAAAATCAGGCTTGTATTTAGTTTTACCA
GTTAGGTTGACAAATACCTTGTTTCAGCCAAGTGCCTGGAAGTTTCTTCTTTGGGGGAAGGTGGGGCTTG
TGGCCAGAAATGGCTGTGGGTCCACACCCAGTGCCGTCACTCATATGTGGCAGATTGAAGAAAGCTTTATT
GTTTCAAAAATAAAAGGTGGGAAGAATTCAGGTATGGGCCTTTGTGGATACCCACTGTGAGAAAAGTATT
ACTTAAAATACCTTTACAAAAGGTCAAGTCCTAGGGTAGATGGGCCTGATCAATGTTTATCAGGAAGTGT
CAGAAATCAGTGTATGAAATCATAGTCAGGTAGAAGTGATCTGAATTTGGCTAAATCAGAGAACAGAACA
GCTCAGCTTTCCCAATCTTGTGAGAGGTGGGAAATATGAATCAGAACCTCAAAAATGGGGAC
TGAGAGAGTAGACATGCACATATCTTCCTAGGGAGTTCCTGTTGTGGCTCAGCTGTAAGGAACCCGACTA
GATCCATGAGGACTCGGGTTGGATCCCCAGCCCGACTCAGTGGGTTAAGGATCCGGTGTTGCCATGAGC
CATGGATATGGGTCACAGAGTGGCTCAGATCTGGTGTTGCTGTAGCTGTGGTGCAGCTATTTAAATAAACA
AACAAATAAAAACAACAAAAACCTTCCTAGATCTCTTCTTGAAAAAGAAAAAAAAGTCCAGTTTCCATAA
GTGGGTTTGTCCTCCTCACAACTATATATGTTTTCCTTCTTTTTGGAGCCATATCATTGTCATCATCCCC
GCTCATCCGTTTATCTTCTTCTGACTATTCATTTGATCTGAGATGTTTGTAAAACCAAGGAACAGAAAGC
ATCTTGATCAGGAAGGTCTGAAGAAGATCTCTTCTTCCTCTGCTGCCATTGCTGTGTGGTCCAAAAAACG
TGTAGATAGAGCCTTAGAAGAGATGAATGAGGTGAAAGGCTTGGAGGTGGAGAGGTGGGTCAGAGTGAGGGG
GTGGCCACAGCCTTTGATCGAAACCATGGACAGTTAGAGCTGGAAGGAACCTTAGAGTCCCCTTGCTCA
ATCTCTCATTTCATAGATAAGAAAAATAAGGTCTCAAGAGTTAAAGAGTCTGCCAGGGGTTGAGCCAGCT
AATGGGCGGTGGAACCAGCAATCTAAGGGCCGATTTTTGATGAAGAACTTTCGCAAGTTCTTCACATAGG
CTCACATAACTGATGCTGAGAGAGGAGAAAGGATGTGAAGAATTTTTTTTCTTTTTCTTTTTGCATAGG
CTGTTTTAATTCTTTATCAATGTCAGTTTATTTTGGTTTGCCTTTGACCTTCACTGCCCCAGCTGGGCAG
CATAAATTGTGGCTGTTAATTTGCTCTCCTTGACAAGTTTGTGAAGGACTTTCTTTTCAAGGAGGTAGCA
GGGTCGAGAAGGGAAAGTTTTTCTGTACATTGCCTACCTCCACTCTGTGATCCGGTCCAGAATGGCCTT
GGCCATTCTTAGGCTGACAGGATGCAAAACGTGGGCCTGGTGTGCAGATGTTCGCCTGATGTGTCTCCG
TGTGCATTACTGGATTGGTTTTGCAGGAAAATCTAAGACAAAGCATTCTGACACTGGTATTAGCCTTGC
CTTCCTGCATCTAATTGATATGCTTTACATTTTGTCTCGCAGAATTGCCACTTAGAAAGAATTCTCCTTT
CATAGAAAGTGGACTTGATTTTTTTTTAAACATATAGCATTATGGAAATGTTGCTGCATTACCAAACCC
TCCTAAAAGGCTGGAAGCTTATTTTTATTTGATCCCTGTCTTTCCTGTGATTTGAGACTAGGTTGTAAA
CAAGCCATAATGCAAAGGGACTACCAAGAGACATACAACAGGACAGGCTCAGAAATAGAAATTGAATTT
ATAGGCAGTGAGATAGGATAATTAGTTTTTATATTTAAAAATATCCTCAAACCAGAGGAGTCTGTTGTCT
CAGATGGAGAAAGGAATTGAGTTTGAATCCCAGTGCTTCACATAATAGCTTAGTTTTCTTTGTATAAAAT
ATACACATAAAGCTGTGTATGTGTGTTTATATATGTACATCCTTTGTATAGTCCTCTCAAACACATGTAT
TAAAGTGTTGGTTTAAATCCCCAAATTCAGATTGCACAGTCGTTTATGCTTATAATTCCTAGCCTTAAAT
GTTGTTCATATAGCTGATTAGCCCACCGTCTATGGTTTTTTCTGTGTTTGGAGTTCCAAG
ATCAAACAAAACCCTTTCCTGCTTTTTGCATGGAGAGCAGGAACTGTATCTGGTGTTTACTCAACATTT
TATGTTTTTCATCCAGCTGTTTTTCACTACAGAGTGTTCATTTAATACCCTGTATGTAGGTAAAACAGTA
CAAGACAGGAGAGTGTGAAGTATCTGCTGATGTTAAATATGTATAAATTCAACCTACCATCTCAAATGAT
GGTGTCTTAGCCACTGGCCTCGTCGTCCTGAAGTGGCAGAAACCAGATCCTGGCTTTGAACCTTAAACAG
ACTTTGTTTTTCAGGGTTGCATCACGACTTTGGGAGGGCATCTTGTCTGAAATGTGCTGTCTCCCCAGCC
TGGGTCAATGGGGACAGAGAGAAATAGCATCTGTCAGTGGGGCGGAAGTCTCCCAAGTGTGGAGTCAGGC
```

| Sequences |
|---|
| ACTGGTTCTTTGCTGAGGGTTCAGCTGATGCAACTGCCACTACTGTGGCATCCTTGTTTCCACAGAAAAA |
| AGTCTAAGAATGGGATGAACTTGTAAACAAGAAGAAACCATGCCTTCCTCCTTACTTGATCTGCCTTGAG |
| CAAAGAAGAAGGCAGAAGCGCAAACCCCTTGGTACCTGCTCTGTGCATCATAAGAGGGTTTCATCCACCC |
| TGAGATCTTTGTCTCTTTCTCTGCCTGCTGTCATAAATCTCAGTTTCAAAGGAAAGAAAAGAGATGGTTG |
| TTAAAGCATAAACCTCTAGGTCAGCTCTCGTTACATCAAACTCCAAGATGATGTTCCAAACCTTTTGTTG |
| AACTGAAATGCTAGAATGGTTTGAAATAAAACTGAGCCATCCGTTGCCTGGGGATAGGAAATCTTTCTGT |
| TGTAAAAAGGTGGCTGCCTGCTTGGTGTGTGGGTGTGTTTGCCTATGTAGAAAGTGGGATGGACTTTGCA |
| GTAGCATTTATTTGCCTTGTGGAGACTGAACACAGAAAGCAAAGAAATCCAGTGCACCTAAAAATTAGAG |
| AAATTGGGTAGGGAAGCTCAGCCATCGTTTTAGAGCAGTTTTCATTCAGGTACAATTTCTTTTGCTTGCT |
| TGAAGTTTTCAGTGTCAGATCAAATTTTCTGTCTTGCACCCCAATACCTCATATGCTTGGTTGCCATCTG |
| TTCATTTCCATTGCAAACTGCTCTGTACACAATGTTACTCAGTGTTAATTAGAACATGTGTCTCTTTGTC |
| ATTCATCTGGGGAAGGGGTTAATGATGATTTATGTCCTTTTGATTCATTTTCCTCAAAACTATTATATTT |
| CAGTTATGATTTTATAAGGACTCCAAGAGAATAGAAAGAGGGAAGAACACCTCATTTCTATTCTTCATGGC |
| CTTATTTTTAAAAACTCAACCTTGGCCTAAATGTTTTAGTATTGAAAATATAGTCCTTCAAGATCTTATT |
| AAGTAGTAACACATAGGAGTGTGCATTTACTGCTTACCAGTGAACAATGTATTATTGTTTACATTTGTTA |
| AATTATTTTAAATAGGTCACATATTCACATGGTTCAAAATTCAAAAAGCCCCCAAAGGGACTAGCAGATG |
| CAAACTATTATAACAGAATGGATAACAACAAGGTCCTATTGTATAGCACAGGGAACAATATTCAATACCT |
| TATAATAAACTGCAATGGAAAAGAATATGAAAAAGAATATATATGTGTATATGTGTATATATTAGTGT |
| GTGTGTGTATAAAACTGAATCACTTTACTATACAACAGAAACTCACACAACATTGTACATCAAGTATACT |
| TCAATAAAAATAAAGAGCCAAAACCCAAAAGGTCCCAGAAGGTTTGCAGGGGAGGGACTTATTCTTCCCT |
| TAACTCCTCTGCCCAGGCACCTGGTTGACTTTCCCAGAATCCGTGTGTTATCAGGGTCTTGTATGTACAT |
| ATAGTTATACTTATGTATACACATATGCATCCATATATATAGGTATACATATGTATATACTTATTTCCCC |
| CTTTTTTAAACAGAGGACAGCAAACATACATGCATATGGGCTTTTCTCTTAAATGCATTTTGGAATTCAG |
| TGTACATTAATAAGTTAAGAGCCAGCGTCCTCTTTCTTTGTTACAGCTACATTGTATTAATGTACTCTGG |
| CTTATTCACCAGTCCCTTACTCATAGCCATTTAATGCTGTTTCCAGTTTTTTTTTCTGGGACAGATAATG |
| ATGCAATGAATAGCTTTGTATTAAATTATTTTGTGTGTCTTTAGAAAGAAATCCTAGAAATGGAATTGCT |
| GCAACCCAAAGTGAGTGTGTTTGGCATTTCGATTGATTCTGTCAAATTGCCTTCCATAGGAGTTAGCGGT |
| TTACAGCTCCGCAAGCTGTCTGCATAATTGTCAGCCTTTTTTACATTTGTGAAATAATAGGTGAAATAG |
| CTATCTCAACTTACAGTTTAATTTGTCCTGTCCTTTCTTTTATTTTGAGTGATGTTTGGTATAGTGAACA |
| ATTTAAAGTAAAAGATAAACACGTGTGTGCTTGGTGTGTGTGGGTGTGTGGGTGTGTGTGTAAA |
| TTTCAAAGATGGAAGCCTATCTGTGCATCCCCTAAAAACACCAATAAACTATATCTGGTTTTTAGTATAT |
| TAGACAGCTAATTTCTGTATTGCTGCATGATTAACAGCAATAAACGCTGGAAGATACCTAATATTCTCCC |
| TTACATGATTACCAAAGCATACTGCTGAAATCAGGTTTCAGCTGAAATTATCTTTAAGAATGATGCATTT |
| TGGACTAATCTAATCAGGCTTTGATTTGTGAGGGTACATTACCTGATATCTTTCAAGATAGAAATGTTAA |
| GTCCATTAAACTGTGGCATGTTGCTTTTTACTAAAAGTGTATGGATTTTAGGGAAACCACACTTTGACAG |
| ACATGATGGGGAAACAAAAGTTCTTTTAGATAAGAACGGCCACTTCTCCTTGATATTTTTCTCTGGGTT |
| GAGCTCTACGTGAAAAGCTGGTGTGGCTCTTTGTCCTGACTGTTGCTTTGCTGTAAAGACTGAATCCATC |
| AGGAGGACCCCATCCTATCAGAGAGAAAAGCCGGGGATTCTGTTATTAGGTGAGGTCTTTATGTGAGGTT |
| AGGTGTTCTCACAAGTCACATAGATCTTTACAAGTGGGAAAACACATCGTCCATTTCTTGGTAGACTGAA |
| CTTTCCATCTTACACTTTAAAAAGGCAAAGGCTGTAATTTGCATAGCTAAAAAGATTGAGTAACCAACCC |
| CGCCTTGGGAATGCCATTTTCTTTCCCCTAGGAGTCCCTAGCTGTGGTTTTCTTCAGGAAAAGAGGTGGCT |
| TCTTTGGCAAGTAGGACATTTGAGAAGTGAGCAGCACTTGCTCCTTTCTGATAGTTGGGGTTTCCCTTTG |
| GGACAAACATACTTGCCCTTGCAGTCGACTTGATGAATGATGAAGTTGGAATAGCTCTCTTTTTCCTCCT |
| TTCAGTCAGGAAATAAACTAATCTCCCCAAACAAAGCTGCCTTGAATGTTTAACAGCAGTTTTAAATCGT |
| TGAAATAGTCACGAGTCACGAGACCAATTTCAATCCTCCCCCGAATCTAGATTCACAAAATTTTAGAGCC |
| AGAAGGTGATTTGCAGATGGTCTAGCAACTGATCCCAATTTTGTACATGAAGAAATCGAAGCTGAGAGAG |
| GTTTTGGATCATTGAGTGAGTGAGTGAATAACAAAGTTAGAAACTCTTGTATCCTGGCCCCAGAATCCT |
| GACTAAATTGTTCCAGAAATTTGCTTAAATGTGATTTTATTTTTCGTAGAAAAACATATGCTCTTTCAG |
| AAATCAATTCAAATTCTCTTGGTGAAATCTTTTGGTGGTTGGTTTTGCTACAGTCCCTCAGCAGGAGAAG |
| ATCATGGAATGCCCTTTAAAAGAGACACCTAGACTGTGCAGCTGTCGAGACAGATAAGTGGAAAAATAAG |
| GTCTTTAGGGATGCTCCCCCATCACGTGGTGATGAGTCTACAGGACAGGGGCAACTTTCTAGTATCTTCT |
| GCTGTGTGCAAAGAGAGAAACCATAGCAGGGCAGGGATGTTGGAAAAAATAGAGGCATCACGGCTGATTA |
| GCTGGGACTGGTCAGAAATGGGTTGCTTCATGGGAAGCAGTTAAGACAAACTTTGTGAGGACTTTTATTC |
| TTTTGGGGGGAGGGATGAGGGTGGAAAGAGGGAAGCGAGAAAAAGACAGAGGGTTTTAAGAACAGAGAGAG |
| GGAAGGAGAAGAAGAGAGGGGCAGAAGGAGGAGCATGGGTCTTACCTGAATCACAGGTAGTGTATTGT |
| CTCAGAAATCTCCTGCTTGGACCAGAGGAACTGTTGCCATTTGGCGGCAGCTGCCTTAAATATAGTCCAG |
| AGTTTTTAAATATTACAGACTTGTCTAGCACCTCCAGAAGGCCTATTTCAGCCCAAGTGCATCATCTGA |
| GGTTTAGATGCCTATAGCTAACTATGGGTTACCTAGGAGATATCTGAGCCTCAGCAGACCGGGACCTGAC |
| CTACCCTCTTAATCCGCACCTCAACCAGGTCTTCTTTCTGAACTCCTTATCTCAGTGAGTTACATCTCAG |
| TCCTCCAAGGGAGCCAAGTCAAAGCTTTGAGAATCACCTTGATTTATTTGGTTCCATCTTTTGCACCCTC |
| TCCTTGGCTGGCTCCACAAGCCCGGTTGATCCCGCCTCCTTTGTGTCTCCCGAATCCTTCCTCTCCTACT |
| TCCCCACTACCGCCGTTCTAGCTCACAACCTCATCACTTCTTCTTGGGTTGTTGCCACAGTCTTTAAGTG |
| GCCTCCCTGCCACCCAGTTTGTGCCTCTCTCAACTTGTCTTCCAGACCGCTGCCAGAGAACTCTTTCTA |
| GGAAAGCCTGTCCAATCATGGAATTCCCCTGCCTGAAAAATGCTGCTGTTGCTGCCTCTCCCTGCAGAG |
| AAACTGTCCAGACCAGTCCATGCTCACTTCCTTAGCCTGTCTTCTCTCGATTCCCTCCTCACAGGAGCC |
| TCCTTACAGCAGTGTGCTTTCCTACCCCGCTGACCTTTGCACGTGCTGTTTCTGCTGAACAGCACCTTCT |
| GCTTCCCCCTGCTTCCCTCTTCCTGGTCTAATTCCTTCGGATCTTTCTGATCTCAGCTTAGGTGGCACTT |
| ATTTAAGAAACACACGTGTGTACATTTGCTGGGTGCCGAGCACTGGTCTAAGGGCTTTATGCGTATTCAT |
| TTACTCCTTAGAACCACAAGAGGAAAGAAGGGTTATTATCCCCATTTTATGGATGAGGAAACTGAGACTT |
| TGTGAAAGAGCTTTTCTTACTGGCCCACTGGCTGCAAGGATTGGGCCAGAAGCCAGCTTTTGCTGCTCGT |
| TGGCACTTGATTTTGATATATATGGGGTATATCTTATACATATATCATGTGCATGTATATAACTTG |
| CTTTTGAATAGGCATAGGTACATATTATTAAGTTCCAAGGATACAAAATACGCAGTGACAAGGAAGTCTC |
| CCTCCTACCCTTGTCTTCTAACCACTTACTTCCCTTCTCCCTGCAAGCCTAATGTTACCAACCTCTTGTG |
| TGTCTTTCCAGGGAGTGCACACACATACACATGTACATACTATATAATTGTGTTTTGACATTTGCGATAG |
| CATATCCTCCTTGCCATTTTTACTTTGCTTTGTTTGCTTAGCACTATTCCTTGGGGCTTGTCCCATATCA |
| ACACATTAAGAGCTTCCTCTCTTCTCTGATGGCTAAATAATAGGCCATTATAAGGAGATGCCATAATTGA |
| TTAATCGGTCTCCTTTTGTTGGATAGTTAGGTAGTTCTCGGACTTTGGCTGGTACAGACATTGCTACAAA |

| Sequences |
|---|
| GACTGGCTTGCTATAGGCATCATTTTGCATGCATATGAGTTTGTGCAGGATAAAATCCTGGAATTGGAAT |
| TTTGGGTCAGAGGGTAAAGACATTTATAATTTTGATAGATAGTGCCAGATTGCTTTCCTAACGGATGTAT |
| CCATTTAGTCTCTCATTAGTAATTTATGAGAGTGCTTCTCTCCTCATAGCCTCACCCGTGCCTGTAGAAT |
| AAAATGTTTTGATGTCCACCAATCCTAATACATTGTTTAGTCTGCATTTCTCTTTTTTCCTTTTTAAAAT |
| TTTTAATTTTTTCAATTCAGTTTTTATTTTGTATTGGAGTAGAGTTGTTTTGCAATGTTGTGCTAGTTTC |
| AGGTGTGCAGCTGAGTGATTCAGTTATACACATACCCATTCTTTTTCAGATTCTTTTACCATATTGGTTA |
| TTACAGAATATACATATTTTTAATTATACTGCTGCACCCACTGCATGTGGAAGTTCCCGGGCCAGGGACT |
| GAATCCGAGCCACAGCTGTGACCTCCACAATAGATCCTCTAACCCACTGCGCCATGCTGGGGCTCTAACC |
| CACATTTCTGCAGTGACCTGAGCTGCTGCAGTCAGGTTCTTAACCCACTGCACCACAGCAGGAACTCCCT |
| AGGTTATTATAGAATATTGAGTAGGGTTCTCTGTGCTATAAAGTAGGTCCTTGTTGATTATCTATTTTAT |
| ATACAGCAGTGTGTATATGTTAATCCCAAACTCCTAATTTATCCTTCCCACCTTTCCCCCTGTGTAACTG |
| TAAATTTGTTTTTTAAATCTATGAGTCTGTTTCTGTTTTATAAATAAGTTCATTGCTATTTTTTAATAT |
| TCCACTGCATTTCTCTTATAGGAATAAAGTTGAGTGACTTTTAATGTGTTTGCGAACTATTTTGGTTTTC |
| TTCTATATCAACTGACTGTCCATTGGTTTTGTTGGATGTTTTCTTATTGATTTATAGGCATTCCTTTTAT |
| ATTAAGGAAATTAGCCTTTGTCTATGATTTACGTTCCCAATGGTTCTCTGCTTTGTTGTTTGTCTTTTGT |
| CTTTGTTTATGGTGTATTTTTCCCAGGCAGAAAATTTTTATTTTCATGTAATCAGATTTACCAAGTTTTT |
| TTTTTTTTTCTTTTATAGCCTCTGGGGTTTGAGTCATAGTGAGGCTGGCCTGCCCCACGCCTAGATTCT |
| AAAATTCTCTTCCATGTGCACATATGTGTGCATAAAGTTGTTTCAGAGAGAGAATCAGTAGAGTATAAAA |
| GTTTGGAAACAGATTCTGGAGTCACACTGACCTGACTTTTAGCCCTGGTTTCATCTTTAACTAGTTCTGT |
| AATCTTGGGTGACATCTTTAGATGGGTTATTAATATCTACATCCTAGGGTTACTGTGATGATAAAATGCA |
| ACAACAGGAAAGTGTCTTGCGTCTGATTACTGATGGCTGCCTTTATTGTGCCATTATTTCTCTCCAGA |
| TTCCAGAATAGCTGCACAAGGACAGAAGCCCTTTCTTCTCTTTCCCTTGCATTCCTCATGTCATTCTGCC |
| CGGCCCCTCCCCAGTCCCGCTTCTAACCTGAGTCCAGGAATCTGCTGGAAGCGCCTGAGTGCTCATTTTG |
| ATTGCTTCACTGTTTATTTTGATTGAGAGGGGAAGGCCTGGAATTCTGGCTAGAGCCACCTGGAGTACCA |
| CAGGTGCTTCTCCACAGCGTCCCTGCTCACCACACATCTGTTCTCCTGGCCCTGGTGTCTTGCCAGATCT |
| TGAAGCTTTGGTTCTTTCCCCCTGTTGTCAGTGAGAGTCTGCGTTCTTCCTTTGTTTTCTTTTCTTTTTA |
| GGCCATAACCACAGCATACGGAAATTCCCAGGCTATGGGTTGAATTGGAGCCACAGCTGCTGGCCTACAC |
| CACAGCTCACAGCAATGCCAGATCCTTAACCCACTGAGTGAGGCCAGGGATCGAACCCTAAACCTCATGG |
| TTCCTAGTCCTGTTCGTAATCTGCTGAGTGACAACAGAAACTCCCCACCTTCTTCCTTTGAAGTGCCTTG |
| CAGCCCTGCCCTGTAGGTCCCTTGCTGCTGTGCTTTCCCTCCATGGATCGTCTTCCCTGGTCTTGTACCC |
| AGGCACCTCCCCTCCCTTTGCTGGGTCTCTGCGGGTGGGTGCCTTTCCTGTTCAGGTTCATGTGCAGAGA |
| GGACAAGATGCAGTGCCGCCACAAGCTGGGTGCCCAGAAAAGCCTGGGACCCAGTGGCTGGGGAAGAGTA |
| AGAAGCTTGGGATGGAGGTATTGATTGCAAGACCCGAAAATCACTTGGCTCTGTCTCCATTCCTTACAGG |
| CCTTGCCCTGAAGGATAGATCCCAAGGCCAATCCCAACTAGTGAGTTTTTTAGTGGATGATCACCCTAAA |
| AATTTCCATCACGTCAGTATCTGTTAATATTTTCTAAAACTTCAGCTAGTTGTCATCGATGCTAACTCCT |
| AGATGCTAACGCCTTAAAAAAGGTGTAAGATGATGCAAGCTGTTCAAAGACATCAGTGCTTTGGAGGCAG |
| CGCTGAGAATTAGACCTTAATTTCCTGACTTTCATCTCTTTTGTTCTCTTTAAAGCCTCCTTTGCCTCTT |
| TAAGGATTTCTTTTGTATGCTTGGTTTTGACAGCCCAGAGGTAGGAGATGCAGTGAAGTAGTTAAGTTCA |
| TCTCATAGGTGATTTTGCCACTATCCTCACCATTAATAAAATAATGCTTGGAGCACAGGCATTGAGTTTT |
| ATAGTGGGCTGTATCAAATGTTAATTGTCACGCATCTGAAGCATGCTGGTACACTGCCAGGCAGAGGGTT |
| CAAGGGAAAAGTGCAATGGGGGATAGATACCAAGCTAAGTCACAGCCACCAGACTCAAAGGCAGCACCTA |
| CTGTGTGTGGAGCCCTTCACTTCTCATTTTACATTTGAGACTTGCAACAATACCCAAAGACGGCCGTCTT |
| TATTCCAATTTTATAGGTAAAGAAATCGAGTTGAAGAGAAGTTGATGTTGACTGTATCATGGTTGCAGAT |
| TTAGGATTAAGATGGTGGACCTGATTTCAAAACCCGGGGTCTTTTGGCCTCACTGCATTTCCTTCCAAGA |
| GCAGACAGTCCAGTAAAGAGGAAAGAGGAATAAACAGTCATGCGACTATTTTCAGTGAAAAGTAAAAATA |
| ATGACCTAAAAAGAAGAGAAACTGATTGATCCCCCTGAGTTCTCTTTCTGGCTGGCCACGTTGGCTGTAA |
| ATTCCATAGTGCAGCTCGTATGGTGAACATTCAAGAGAGAAAGGTCACTCATCCGCAGTCCTGCTCCCCA |
| GCCCCCACCTTGATAAAAGAAGTCTCCTTACCACCTGACTCTCCTGCAGGTAACAAAACAGGTTTTCAAA |
| ATATGTAATAAAGAAGCCCTGCTTGTTCCTTCCTGGCAGTCATCCCAGTGGAGTACAATCACACAGGCA |
| CTGCCTGGGACCCTGGGCTGGAGGAGTTAATTTTTTAAAAAATGCTTGAGGTTCCTGAGTTCCCATGGTA |
| TGTTACTAGAAGGTTCTGTAGCTTGAAAACTCTCAGCGCTCATTTCCCCCAACCCCTCGCCATGCCACAC |
| ATTTAAGGACAGGTTGGCTCATCATCAATGGATGCTCCTCAATGCTTACATTCACTGTGCTTTTTCTTGG |
| AAGGATTTCAGCTCTTCTGTGACATAGTTCAGTTATCTCCTCTCTTGCTTCCAGAAGCAGCTTCTTTACC |
| TCAACTGGAAAACTTGCTGTAGTCCTGAGTGTTTTGGAAACAAAATGTGCAGTGGGAGAATTCCTGCTTT |
| GTGAATATCCGATCACTTTGTTCCCTGGCACAACAGTCTCTCCTTTGTATTAAACGCCTGAGAACAGAAG |
| TTCTAAATAACATTTTTATACTCCCTGTTGATAGAAGTTCTGTATTCAGGGACAACAGTTTGATGCTTGT |
| TCCTCTGTCAAGTTCTGATGTCCTTTCCCTGCTTAAGTAACAAGGGTGCTCCCTCCCAAGCCTGGAATTG |
| CACTTGTGGGGAGGAGAGGGTGCCTCCCCGAGGACTTTCTCATTGGGGCTCTTCTGTGTCCAGTGAGTGG |
| CCTGGGCCTAGTGGGATGGCTGGCTGCTCAGAGCAAAGGCACCGAATCTGCTGGTCTGACCATGAGCCT |
| AGTGGCTGAGCCAGCCAGATACAAAAGGACCAGATGGGCTGACAGACCAAAATAGCCACTCCATCTCCTT |
| CCTGGAAATGCAGAAGGGCTACCCCGGAAGTCCAAGAAGGCCTAATTTGGTCAAAAACCCGGCACTTACT |
| CAGACCAGGAGGTTGGGTTGTGACCCTGGCATGAGTTCCTGACCCCCAGTGTTTCGTTGTTACCAGCCCC |
| ATTTGCACATCCTCAGGTTGACAGCCCTGATCAGACAGACACCCAGACAACTGATTGGTAACAAATACTC |
| TTAACACTAAAGCACCTCTGATCACTTCCCTTTATTTTGTACTTGTACAGAGTACTTGTACTTTTACTTT |
| AAACAAAAGATGTATATGCACGCTCATCTTTAGACAAACCCAGTAGTATAAAAATTCATTTTGGAGTTCC |
| CTGGTGGCTCAGTGGGTAAGGATCCAGCCTTGTCACTACAGTGGGTTGCTGCTGTGGCTCAGAT |
| TCCATCCCTCGCCTGGAAACTTCCGCATGCTGTGGGTGAGCCAAAAAATAAAATAAATAAAATAATTCAGCT |
| TTGTAAGATGAAGTAGGACACTTTTATTTGTTTTCTCAGAAAATTTATCACTGCGTTCCAAATGGCATAG |
| ATAGAATAATAAAATATGGTCTACTCCCAAAGAATGTTTGTATTTCCGTGTAAGTTTCAAAGCTCTCCCT |
| TTTTCTTATTTATTTGACAAATACACATTTAATTATCCTACTGGAGGCAAGACTGCCCTACATGGCCATC |
| CTGTAGCTCATACAGGGAGCTCATTGGCTCTCGTATTTTATTACTTTGGGTCAAAGATAAGTTTCTTGCC |
| CCTCATTCCTTCAGTGAATATTTTCTCCTGTTTCCTGTGGGCCAAGCACTGTGCTGAATTTTTCGGTGT |
| TTCCCGTGTTCCCTTTGGGAGTGGTTGGAACGGTAGTGCTGTTTTCGCCCTTGGAGGAAGGGGGCCATGC |
| CTAGGCTCACCCACTCCCCGGCAGCTGGGCCTTGGTACAGCGAGGAGGGCCTGGAAGCTGATACACAC |
| ACAGAGGCCCCCTGAGCCTTAAGCACAGGGATAGATTGTATTATTTTCTAAGAGAAAGGACATTCTACTC |
| CTCCTCGTTAACCTTCCCTTGCAGGCTAAAACAGGCAAATCACTCCCTGGACAGACCAGCTCAAGTGATA |
| ATAAAAAATATCCTTTACCAGGCAGCCTGGCAGTACCTGCATTAGTGTTTGGATAAGAACAAGCCCCTCG |

| Sequences |
|---|
| AGGGGGAATGGAGCCCTTCTCCAGACCTTAATTGATTTTTGTGTTCATTCTGCTTCTTTTAATTCTTAGT |
| GGAAAAGTGATTTGTAGTGCAAAGTGGCTTTCCATGTTATAGGCACTGGATTATGTAATCCCGCTCTTAT |
| CAAAAGATCATTTCTGCTTGCTTTGCCTTTTTTTTTGCCCCCGATCCAGCTCATGTTTATTTTTCTTTTT |
| TGCTTTATTTCTTCTTGTTTACACAGTTATTGTTCCTCTTACTGCTCCCACTTATCAATCCCCATCATTG |
| GGGGAGGCAATAGGATTCCCTTGATCTATTTTTTTTTAATTTTAAAAGTCAGTTTGTTGGACATCTTTA |
| AGGAATAGTCACTTATTCCCTAGCAAGTTTGTTTCATAATGTGGAGCGTCATTAATTATAAGTCTGACTC |
| CCAAGAAGCTGGGTTATGTTCATTCCCAGGGATTAAGGAACATCCTGGAGTGTTTGTCCCTTTGGGATCT |
| GGGCCATCATCTGCCCCTCCTGACCAAGGTGAGCCTGGCTCATGAATGGGATGGCTCCTTACAGAGGTAC |
| CCTGTCATGTAAGAAAGTCCCATAGAAGAGTAACTACTAAAATCTCTTTCCTAAAGTGAGGTTGTGAAGC |
| CCTCAATCATGTGCCTCTTAAACAGTTGATCTAAGAAATCCACAACTTAACCGTCAAGTCTGTTGGCATC |
| TTTGAGTTACATTGGGAGGGAACTCTGCCTGTGTCCTCATGTGATACATCACCTTGTGCATGCTTGCACA |
| TATGTACACCTGTGCGTGTGTATGTGTGGATTGAGAAAAAGGAGATAGCCCACTGCTAGGGGTTGAAGGG |
| AAAGACTTTGTTAGGTTTACATCATGACTAAAAAGACAATTTGTTTATTGCAGTCTTCATGTGATCAAGA |
| ACAAAGCAGATGAGAAGAAGCCCAACATGATCAAAGCACATCTAATATCTCAGGTTTCTAGAACATCTGA |
| GTCTCAGGGTTTGGTCTTCATTATGGTATATGCTGAGAGGTGATGTTTAAAAACAAGAAGGGGAAAAT |
| GCCAGCTGTGAAGAACTGAGACAGTGAAAAAGCAGACGTGTGCACCTGAACGGAGCCCCTTCTAAATGGA |
| GCCATGCTCTCTTCAGTCTGCAGGGCAGAGGGAGGATTCTATGAAAGGTCATAAAAATCTAGCCATATA |
| GTTCCTTCTGTTCAGTGTAGATTCTCACATGCAGTGGCCTTAAGCATTGTGACTTGATTTCTCGTGGGCA |
| CAATTCACACCTGTCTTGGGAAGTCCGTTTGGGGTGATCTTGCCACCTGCAACTTGGAAGAGACAGCACT |
| TGCTGAGTCTGGACGTCTGATAGCTGGAAGGGCAGGACAGGTGACCCCCTGGGTGGCTGGGAGGTGTTAC |
| CTTGAAACTGAATGCTGGGATAAAAATAAAACAGTTTCTCCCGGGGACAGGGCACTGATGGGAGTCAGGA |
| TCCCTGTCCTGATAAAACGCTGCCCCTTTGTTCTGCTCCTTGTGTGTTCTTCCACATGAGGCCTGGCAGA |
| CGGTCCATTTAGTGTTCATTATGGTGTCAGAGCCAGCACATGGCAGGGTGCTCCCCAGCTGCCACGGGAG |
| CCGTGCACACATGGACGTGAGCAGAGGCCTTTGGTGCACACGCATGGACTTGTCTTCTGCCTTGTTTCC |
| CTCCCAGGGTGAGCTGGGAACCCAGCCCCCATCCTGCACCTTCTGGCACAGGGGCTAGTGGCCCTGCATG |
| AGGTTCTACAGTCATCAATAGGCCTGTTCACGTGAGAGGTGACTTCACATTTTTGCCACAACATCACAGG |
| CTGCTGGGCTGAATGTGACCATTCTTCTTAGAGCAAGCTGAGGGCAAGGGACCTCTTCCGTCCATCCATC |
| TGTCCATCCGGGAAAGTCATCACTCCCATCACAGATCCAAGGGACTTGATCCAGGCCCCCCGAGGGAGC |
| ACTCAGCATTTCTTTTCGTGGGTTAAATAAAACTGGATGAGCAAATGATTGTGATTAAGCTCTATTGTGA |
| GGTTTTCTGATACCCATGTAGCCTAATCACTGAAATCTTTGTCAGGCCTTGTTTTGCATGTTAATCCATG |
| AAGGAAGCCAGTGACAGCCTCTCTGAGGTTCTCTGTTTTCATTGTAGTTTATTCTTAATCATCCAAGTCA |
| ATAGGGAAAATTACCGTCATCGATGATACAAACCCACAGAAAGTCCAGAAATACTCGAGATGGGGACAGC |
| AGGCGTGTGAGCCAGCACACATGCTCTCTCGGACATTCAGCAGCTGTGCGTCCCTGAGGACAGACAGGGA |
| CAGTGTCCAGGCAGGGTCCACTGCAGGGGTGGGGGCGAGGCCAGGGGGTCAGGCGGAGGAGGTGGTGGTC |
| AGTCTCAGAGTATGGCATCAGATGTGGAGAACTGACCACATTTCCCTCTGATGCCATCCTGTGGATTTTT |
| TTTTTTTTTTTTTTTTTCTATTTTGGCTGCAGCCGGGGCCGGGGCCAGGGATCAGATGTGAGCCAT |
| AGTTGTGACCTAAGCCACTGCTGCGGCAATGCCAGATCCTCAACCCACTGTGCTAGGCTGGGGATCAAAC |
| CTGCGTCCCAGCACTCCCAAGTTGCCACTGATCCCGTTTCACCAGACCAGGAACTCCTTTTGTGGATATT |
| TTATTTGTACTTTTTAAAGATCAAAGTAACCCACCTGTGTGGTCAAAAAGCCAAATAGAACAAAAGGCAT |
| TTAATGTAAAATAATGCTCCTCTCCTCCCTCAGACCCACTTCTCTAGAGGCAATACCTTTTAACCCTCCCT |
| CAATTTATAAAAGTTATTTTCCTGGTGACCTTCATCTCTTTAAATAATAGGTTTACCTGTTGGGCTAA |
| GGTCTTAAGGCTGCTGTAGCCAAGTATCTCAAACAGGGTGGCTACAAGCAACAGGAATTTATTCTCCTGC |
| AGTTCTGGAGACTAGAAGTCCAAATCAAGGTGTTGGCAGGGCTATACTCCCTCAGGGAGAACTTTCCT |
| TGTCCCTTCCAGCTTTGGGCTGTGGCTGCCTATCCTTGGTTGGCAGCTGTATGGCTCTAGTCTCTGCGGC |
| TCTGGTCAACTGCATTCTCCCTGAATGTTTGTCTTTAAGTGGTGTTTCCCACTTTTTTATAAAGACACCT |
| GTCATTGGCTTAGACGCCACTCCAGTGACCTCTTCTTTGATCTGCAAAGACCCCATTTGCAAAAAAGTCA |
| CATTGGCAGATACCACCGTTAGGAATGGAACGTATCTTTCGGGGACCCAATTCAACTCCTAACAACACTC |
| TTTCTCAGTTTGTAAACATTTGGTTTTATTGACTTCGTTCCCCGGTAGATGGCATTTCTCTTCCCAATTC |
| AGCCCGTTTCTCCCGAGCCTCTTCCCTCTGTGGGCACATCAACCTTCCCAGTTCCTTACCTTAAAGGATG |
| TGGCTTACATTTCGAACACATTCTGAAACTTCATTTCATTTTTCCATTAACCATAGAGAGCATGACTTAA |
| TTACCCACTAAAAAAAGTGACAACATTAGCTCTTCTGACTGCCCTCCCTTCTCCCACCTTCCAGCCTCTG |
| TCTACTAGTGCCAAGTTTGGGAACACCTGGGTTCTTTCCGGGTAACTAGTGGTTAAATCCTTTGCCATCT |
| GTCCGCAGATCAGAATTGATGTCTGTCTGTAGCTTCTACAGAGAGAGATCTACAGGTGGAAATCAGTAA |
| ACAGTGTTTTCATCTTTATTATTATGCCCATACCTGCTGTATTATGTTGTCTTTGTGTGCCCTCTGGGTT |
| TTAATTAAAATGCTTTCTGCTTTTTGAAGAATGACAATATAAATGTATGTTTTATAGTACTTTCGAATCC |
| ACATTTCATTTGATTAGGTTTTAGTTGTCAGTATACTTTCCTAGCTTAGTTGGGAAACTCCATTTATTAG |
| TACAGCTTGAAATCCTTTTGCATTAAGTGTTGAAATGAAACTTTTGTGTCTTGTGAGGAAATGCTTGATGA |
| AATAAAACAATACCCACTCTTCATGGGTCTCTACTCTTCAAGAGTTTCTAACAGCAGGTAAGTCATTCTT |
| AGGCAGAGCTAGCCACACTTTTGTATTTCAAAACTTTTATTTTTATTTTATTTTTAAAATTTAAGGACCA |
| AAATAGAGGTGCTAACTTCTCATTTTGCCAAGAGATCTGGTATTTACTCTCGCTGGTAAAATATAGAACA |
| TTTAACACCCAAAAGAGGAAAGACATGGTCTTAGAATAAATTGCACTATTTTAAAATGGAATGATATCAC |
| TTATATGTGGAGTCTAAATTATGGCACAAATGATCTATCGACAAACAGAAAAGATCATGGACATATAGG |
| ACAAACTTGTGTTTGCCAGGGGGAGGGGAAGGAGAGGGATGGATTGGGAATCTGAGGTTAGTAGATGA |
| AAACTCTTGCATTTGGAGTGGATGGGCAATGAGAGCCTGGTGTACAGCACAGGGAACTATATATCTAATC |
| ACTAGTGATGGAACATGATGGAGGATAATGTGAGAAAAGAATGTGTATATATATATATACACACACA |
| TATATATATGACAGGATCACTTCGTTGTACAAGAGAAATTGACAAGAACATTGTAAATCAATCATAATG |
| AAGATTTTTAAAAAGAAAATGGAATGAATTTAACTTAAAAAAAAATCACTACGTTCCCATTTTTTCCCC |
| ATTTCGTGTAGACTAGTAGAACTGGACTGGATGGAGGGTTTCCTAGATCAACCTTGATTCATGGTCGTGT |
| ATTTGGTTTAATGGATGTTTGAATATAACTGTTAATTTCTCCACTTATTCTTGGCTGGTTAGTTTGGTT |
| TACTAGAACCCAATATAGCAGATACTCAAGAACAGGGGCAGGAGTTCCCATTGTGGTTAAAGACCCGACG |
| TTGTCTCTGTGAGGATGTGGGTTAATTCTTGGCCTCGATCTGTGGGTTAAGGATCTGGCGTTGTGGCAA |
| AGGTCATAGATGCGACTCAGATCTGGTGTTGCTGTGCTGTAGGCTGGCACCTGCAGCTCCAAGTCGACCC |
| CTAGCCTGGGAACTTCCATATGCTGCAGGTATAGCCATAAAAGAGAGAAAGAGGGGGAAAAAAAGAAC |
| AGACTCCATATGGGGTGAGAAGCTTGCTCATCCTATTTTGGGAACCCAAGCTATAGCTTGACCCCCAACA |
| TCCATGTGTACTCCAGTCCAGGCCACCTGGGCTAGTTCATAAATGTGGGTTGGACATGAGAGCAACAGGT |
| GAAAGGGATCTCCATCCGCACATGCAGATCTGGCACTTGTAGCCCTCGAGTAAGTCACCCTTTAATTCTG |
| TCTTAATTTCTTTTTCCATAAAGTGGTCACAAAACAGTATCTGCCCATATATGTTCTCCCATTTTGTAAC |

-continued

Sequences

```
TGAGGTTTGTAACTGGCAAACTCAAGTATTCAATGGTTGCACGATGACAGCATTTCTATAGTATTCTTAA
ACGAAGCTAAATCTAAAGCAGAATGAAATCACTGACTATATTTGTCCCATTAAATAAATCTGATTAATTA
ACCATCTGGTTCAGTTTTTTCTCTCCTTGAAGCACTTGTAGTTTGCAATATCCCTGTTGTGAGGTTTTAG
TATGTTCCCCTGCCACGGGCAATTGAATTTAGTTTTTCAGAAATTTAATGTTTTTAATATGACATTTTGT
GAAATCCTCCCAAACACGAACAAAATTAATTCCTTGGTGGTGGTGTTGCTGTTGTTTGTAAGAAACGTTG
GTGTGTGTGCCTGTGACTGACCTCAGACGGTTGTGATGCTGGTACTATTTAGCACGTGGTGCTGTGCTAG
GACCGTGTGGTTGAGAGCATTGATTAGGTGATCTTCACAACATCCCTGAGAAGTAGCTTGACGTTGTCTT
CCCACGATTTTCACACAGGGGAAGTCCATGGTAGACCAAGGTTAAGAAGCGAGTGGCCCAAGTTTACTCA
GCAAGTTGGTTGCAAAGTGAGAAAGGAAGTCCAGTGTCTTGAAACCACATCACCTATCCTGACTGGCAA
GTGGCATCTCTCTGGGTTCATATTCCTGATTTTCAGGATTCACACCAGGCCATTTTGGTCGTTGAAGAAC
TGAACAATGGACAGTGGGATGAATCAAGCATGGCTTTCCTGTTGGAAGCACAGAGTTGTGTCCCTGGAGG
TTTCGGTGCTCTGAGAAGTGGAGGGAGAGATGGCTGTCATGCTCCTGAGTGCAGTACAGCCCCCATCCAG
GGGGAAGGGCCCTCAACCTGTAGCACCCCCAAGCTTGGTCTGTTTACTAGAGTAATGGTCTAGATCAAG
TGGTCCACACTGCCATTCCGTTTCATTGGTGACCAGCTGACATTACAGAAAAGATCTGGTTCTAATTCAT
GGAAGGTGGACAAAGTGACAGGTGCTGACCTTATACTGCTCTAACTCTGTAGCACTTGGCTCTGTTGCACC
TCAGCTGTGCCATCAATAAAATGGGAAATGATATTTAGTGCCTGAAAGCAGAGGATCAGGGCAGACCTTC
CCATTGTATGTACTTTGATTGTTCCAAATGCCCCCAAGAGGAATCAGACTTGCAACCAAATGCTCTTCTG
GTCGAAGCACTCCTCAGCCAGGGTTCCCAGCCTGAGGACTAGATCCAGGTATAGGCAGGGCAAGCCTCAG
TAGCTTCACATCCTGCTCCTCTCTGTTTCATTTCTGCCTGAATTCCACATGAACCTCAGAAGACCTCATT
CCTCACTGTCTGTTTGTCCCCATCCCATGGTTTTTGCTGAAATGCAAGGCATGTGCTACTGTCATGCTGT
CAGGACGGTGTCTTATGGTGATCCACCTGGAGATAGGGCCTTCATTGGAGTTGGTGTCAAATTCTAGGTG
TGGGAGTTCCTATCATGGCTCAGTGGGTTAATAACACAACACAATGTCCATGAGGATGTGGGTTCAATCC
CTAGCCTTGTTCAGTGGGTTAAGGATTCAGCATTGCCACAAGCTGCCTTATAGGTAACAGATGCAGCTCG
GATCTGGCATTGCTATGGCTGTGGTGGTAGGCCAGTAGCTGCAGTTCCAATTTGACCCCTGGCCCAGGAAC
TTCCATACGCCTCAGGGGCAGCCCTAAAAAAAATTTCTAAGTGTAAAGAGCAAGGACAACTCGAAGGTTT
GAACCACCTCATAGTGCATCTTTCAAGAACCTGTATTTGGAATATGTGTATTAACTTGTAATACAAACAT
TTGGAAGTTTCAAATAACACTGGCCCACTAAAAAAAATACTGGTATTGATTACCCTGATCTCAGTGATGA
GGCGTACTCATCAAAGAAAAATGGGATTCAGTGCAAGCCCATTTTAGTTTTTGTCTAGTCATGTTGTACG
TGGGAATTGTTATAAAGCAGAAAAGCCACCAGGCATTACTTTATCTCCCAAGCAAACATTCTAAATAGTG
GGGAGCTTGCTGTACATAAAAGGAAGCTTTCTCTCATGCCAAAGCTGGCCGAACAAACTTTGAATCCTGA
AAGTAAAACCCAAAGACAGAATAACTTAGACAAGCTTTTAATGGGTGGAAAATAAACATTAACTTTATAT
GTATTTCAAGAATGTAAAAGACACAGGTAGGAAATGAATCCTCCTCGATAAGAAAGAAAGCTTAGTAGG
GTGGAAAAAAAAAAAAAAGAAAACATTCAGTAGTTTTTGATTTTTGGAACTGTGCAAGTCCAGACTGTTT
CTTTCTTTCCTTTTTTTTTTTTCTGGTTAGCTGCTCATAGCCACAAATATGTATATTATTCCTTCTTGC
CCACAATTATACTAAGAATCATTTTCTAATATACCGGGGAATCCCAAATAAAAATCTCATTTTCCTAAA
AAACAGACAAGTCTTTGACGGTAGTAATTAAATTATTCAATCGTCACAGCTAGAATGTCAAAGATATAA
TCACATTGTTATAATAGTAGAAGCCTCTGATGCCCACCTCAAATAGTTTTCTCCCCAAATTTCTACTGTA
ATCGGCTGATGTTCTTAGGGAAGGTTTGCCTCGGTCACTGATGTTTGAAAACAGCACTTAGAAACCTTCT
TCTCTCCAGTGATTAGGCTGACCCAGTTATGCAATGTAAGCAATAGAATCACAGGATATTTTAACCCTTT
TTTTGAATATATATTTTTATGTGGGATGCAATTATTAACTACTTCGAATACACTTCTTGTGGAGGTGATC
AGAATAGGAAACCCAGCTGACTCCATAGTGGGTCAGTAAAGTGTCATGTCTTAGCAGCATGGATGGGAGA
GAGCCTGCGTGGATTCAAGACTCAGCTCTGCCCTTTTCGACCCAGTTCTTGATGCTTCTTTTTCCTCATC
TGCAAAGCGCCAGTTATAATAACAACACCTCCCTCATAAGTGTGGTTGTGAGTTAATATGAGTCAAGAGC
TTAGAACAGTGCCTGGCATGCCCTACACCCTGTGTCAGTGACAGCTATTGTTATTTTCACAATGAGGGAA
ACAAGGAACTGTGTTTCTCCCCGGGGGTAATTCTATTTGCCATTAAAATATGTTTTTGTTTACAGAGTTG
GTGAGTGTTGTCTGAGCATTCTCATTTAAAAAAAAAAAAAAGGTCTGAAACTACTTATTTTGCCTTTTCT
GCTTCCTTCTTAATTTCTGCCTCTTGCCTGTTTTCTTCTAGGTCTAGATCTGATAGATTTCTCTAGGCAG
AACTTCTCTATGCAGAACCTATGCAGAACTGACCTGATTGAACTTACCTGGATATGGAAGGAAGTAAACT
ACATTTTATTGGTGCTTTTCCACGAAAGCATGAGGACATAGGCAGAAAGTGAATAAATAAAGGGCATTTG
CAATGGTAATGAAGCAAGTGATAAAGTAGGTGTTTTCAATTCGCTTGAAAGTAAAGTTTCTGTCCATTAA
ACTGACTCGAATGAATGATCAAGATTTAACAAGTTCTGGAGTTCCCGTTGCGGCTCAGTGGTTAACGAAT
CCGACTAGGAACCATGAGGTGTCAGGTTCGACCCCTGGCCTTGCTAAGTGGGTTAAGGATCCGGCGTTGC
CGTGAGCTGTGGTGGCTAGGATTCCATGTTGCTGTGGCTCTGGTGTGGGCCAGCAGCTACAGCTCTGATT
AGACCCCTAGCCTGGGAACCTCCATATGCCTCAGGTGTGGCCCTGGAAAAGACAAAAAGATTAAAAAAAA
AGAGAGAGAGAGATTTAACAAGTTCTGTTTCCTTGTAAATTTTTGCTTTTTATATCTAATAATCTTACCG
AATGAAGATCCTGTGGATGTCTTTGTTTGAGATGTAGAGAAAATTAGCATTATTTATATTTAAACAATGA
AATCTTGGTAGAGACACACATTCACCCTTGTCATTCATTTTTGTCTTTGTTTTTAATTTTCAAGTGGTAA
ACCTAAAGAGTTCACTACCTAACACTGACTAAAAAAAATTTACCTTGACATTCAAGTATAAAATACCCTCC
TTAGTCATTCTTTTTCTTAAGGTTACACAGTCATGGTTGACTTTTATGTACTAAAATTTTAAAATTTCCC
CTTGCATCAATAATGTAAATCCATGATATCCATAAGCTGAGTTGCACATTAATTATTATAAAAAGCAATA
TAAATCCCCCAGGCCAGCATTTTATTTAATTTGATTATTCATGGATTTGTGACTATTATTTGTTGTTGGT
TTATTGTTGTTGCCAATTTTAATACTCGGACTTATAGACCATATGTTGTTTCAGAAACTTCCCCAAAGGC
AGTAAATTCCACTAATAAGTGGGGAAATCACTTATCTGTGTTCAGAATACCTCAAAAATGCAAATACAGA
AGTTTGTGAATTTTACATTTGTATTACTGAGAGGTGAATATGAAAAAAATACACTCATCATTTATCGATT
GAATAGGTCTAAAAATCTTCTTTCCTCATTCGAACTATAGGAGTTTTGAAGAGTATATGTTTTGATATAA
AATGAAAATATGCTACCACCACCATCCTCATTATAGTATTCATTGGACTTGTATCCATCAGAGATTTCAT
GGAACATAACCAGTGATCGGCACTGAGTGACAGAAGCCTGTAACTTCTGATGTTAAGCGGTCATGCAAAA
CTTTGCAAATATATTATTTGGGATATTCAATAATAGGAGAATTCAGTTCTCATTACTTAACTTGCCTTAA
TTTTCATTAAAAATTTTCATTTCATTAATAGCAAAGTAAAAAAATCACATTCACAAGTGATAAGAGTATT
TTGATGGAAAACAGAGCTCCCTGTGTGTTCTTCCCTGCAGCAGGGACTAATTTCAGATATGCAAATTCCT
GGTTGAATATGTAATTCCACATGCTTTCTTGAGGGCCTCTTCGAGGAGGGAGTATAATACGCTAGCAGG
AGTATGTGTTTGGAGTCAAACTGTTCTTGGCTCAAATCCTGACACAGTTTCTTGCTTACTGTGTGGCCT
TGAGCTGCCTTGTCTTTCAAATACCTGACCCAGGAGTTGTTGAAACTCAGACAGAAGATGTTTAAGAGTT
AAGTGGGAGGCTGGGGATGCAAGTGTATGATGTTCAGCGAGTGCTTTAGTGCTTTCCTGCCTCCCTTTCC
TTCTCTCCCGTGGGAACCCCCTGCTGTAAGCCCCATCTGCCGTGTGGGTGGGGGACAGAGCATAGGTGCC
TGAAACTACCCTTGCCTTTAGGGAACCTGATCGTATTGTATTGTAACATCTTTAGCTGGTCCCTTCGCTG
TGGAGGACGTGGTTAACAGCTCTGTTACATTCGGGGGTTGACCTTTATGATCATTTCGAAGAGCACTTCC
```

-continued

Sequences

```
AGATCTGACCTTCTTTGAGTTGATGATATCATGAAGCAATAGGTTAAAGAATAGGAGACAAACAATAGGG
TGTTCAATAGTGTGCAGTGTCGACCACAATAATGTATTGTGAAGGAAGAGACAATTGAAGCGAATGGCAG
ATTAGATGTGATTAGACACGGATCAGAAAGTGCTCTAAAGACAAGTTCCCTAGTATGTCCTCTACAAAAC
ACTCCCTCCTCAAGATGGTAACAGGTAGGAATTGAGAAACAATTTCTGAAAGTCACATGGGAAATGCTGA
CTGACACAGGTTTCTTTCCAGTAGGACTTTTCAGAGTCTTTCAGATGCACAAGTGTCTTTTGATTCCGAA
ATGAGGGTGTGTGGTCATTGTCTGAAGCATTTCCAAAATGTATTTCATCATAGAATCAGAATTATTTTGC
ACCCGGGTAATATCTTGCTGGACGAATGCTTCATGGAAGGTATTTTGCAAATCATTTCTCTATGGTTTTA
AACCAGGAATGTAGGACATGGGTACCATTGATTCAAGCCACCAAATCTACTGAGTGTTGACCACTTGCAA
GGCCCTGTGGAGGCCAGAGATGAGTAAGACCCAGTCTCAGTGGCCAGTCTGGTGACCAGGCTTCGAGTGA
GGTGTTGGTGGCAAGGCTAAGGGCGGGAATGGCCTGGGGAGACGTCTCCCAGGGGGTTACTGATGCAGAA
TCAGGTGAAGCAGCGTCCTAAGGATGAGGAGTCCTGCTTTCTGCCTTGTCTTCCTCTCTCAAGTTCTTAT
ACTGGTATTTTTTTAACCTGTTCACCTCAGAGAAATTCTGAAGAGAAAATGAACGTTTGGTGTTCCACGT
CAGGTGGTTGGAGTTAAACCAGTTGGAAGGTTCATTTAGAAGATTTTTAAAAATTGACTCTGAGCTTTAG
TTTTGGGGAGAGTCATCTCTCAGTATGTGAGGGGGATTGGTTCCAGGACCTTCCATGGAACCAAATGTG
AGGATAAAACGGCATAGCATTTGTCTATAACTTACCACATCCTCTTGAATACTTAAAATCCTCTCTAAAT
TATTTATAATACCTAATACAGTGTTAACACTGTGTAAACAGTTGTAAGTACACTGTAAATAATGGGTAAA
TAGTTACCAGCCTATGTCAAATTCGTGTTTTGCTTTTTGGAACTTTTTGGAATTTTCTTTTTCTGAATAT
TTTCCATCTGCTGTTGGTGGAATCACAGATGTGGAACCCGTGGACACAGAGGCCACAGGTGCCTGGTTGT
TTCACCATCCCATTGACGTACAGCTCTAATGTCAAAATCTAACCCAAGGAGAGGAAGCCTGGAAAAACAA
ACAACACACAAGGCAACCAGCTCCTTTACAAGAGACGTGGTATTTCATTCAATGTTGGTTGAACCCAATG
GCGTAATCTAGAGTTTCCTTTCTTAGGATTAAATATGAACTAGGGCCTCATGGCGGATTTTCCTGGGACG
AACCTTTCCTCTCACCCGACAGATCTGTGGGCTATTTCACCACTGGCTTGTGCTGCCTCTTAGGCCTTAG
GAAACGTTTTGGCAGGTTGTGCCGTTATTTTGCTCATGTTGTGAGTAGCATTTCTCTTGACCTTTTGTTA
TTTACTGAAACAGTCCAGCCTGTTTTCTTTTAAGAGAAGCGTGAAATGAAGGGGAGTCGGCTGACTTTGG
TATCAGAAGACGGACTTCAGGCTGCTTGGCTTCAAGGAGACTTTTCAAGTGAGGGGGTCACTAGCCTCCT
TGTTTCTTATTCACAGAATTATAAGGGGTCTTTTCAGGGGAGTTTTTTTTTTTTCCTCACTAAAACAG
ATACATGTAAGGTTACTCATTTCTTTAAAACATTTCCCACATCTAAAAACATAACTCTGTAAGAGTTTTT
TTCTGACATCTTGGGCATGGTGGGTTGTCCAGGGTCTCTCTGGTTTTGAACGTGCTGGGACGAGTTTCAG
GGGAAGACAGCTCTGACTGGTGACGGGCAGCCCAGGTCCAGGGGATCCTGACTGACCTCTCATGACTCGT
GTCTCATGTGTTTCTCAGCGTCTCACAGGGGTTCTTTCTCCCTTCTTTCTGCCTACCTGGGTGTGCCACA
CCTGTCTCACTGGTGCTTTTGTGCCTCTGCCCCTGATAGGGGACTCCCCATTCACTGCAGGTAAAGGAAG
TACCAAGATCCCATCACATCTTTGAAGATGAGAAAAAATGTGCGTGTATTTCAAAGCATATGCCCTA
CCACCGAGCTACATCCCTAGCCCTGCTTGTGTATTTATTTATTTATTTTTCCATTCTTGGCCGACCCTGC
GGCATATGGAGTTCCCAGGACAGGGATCAGATCCGAGCCACAGCTGTGACCTAAGCCACAGCTGTGGCAA
CACCAGATCCTTAACCCACTGTTTAGGCCAGGGATTGAACCTGTGTCCCAGCACCCCCAAGACATGGCC
GATCCCATTGCACCACAGCAGAAACTCCTGCATATGTATTTACATACACTCTTGTTCCTGGATCCCCATA
TATTTACCTACTACTGGTCTCTGCCTCAGACAGAAAATTCTACAGGAAATTACGTCTTTTCGTTGGGCTT
CCCATAGCTCTTGAACTCAGCTGCTCGCGTTAAAGACATCACTCACATTTTTGTCATTTTTGTTCTCTTA
GCCAAAGAAGATGACCTTGACATACATAAATCAGCCCCAGTGATTTCTGTCTCATTCTGTATGACCTGTG
GGTTTGAGAATTGCCACAGTCTCATCATGGGCCGTTGCTTTGGAGATGTTTGATTCATCTCTTCAGTCAT
TCAGTCAACAGATTGTCCTCAGTGTTGGGTTGCACTGATGGACAGGCCACGGGCTTCTCATGGAACTCA
TAAGTGAATACAGAGGCCTAGATGATATGCAAGTAAACCAGAAAGTAAGGAGTTGGTAGACAGCAGAAGA
AGAATGCCAGATAAATGGGGAGGGGTGAATTTGTATAGATCAGAGTGTCCCTGGAGATGTTGTTGGGCCC
CAGACCTGTCAGATAAGGAGGAGTCCTGGAAGTCCTGGGGGGACCTTTGGAGATAGAAGGCAGAGCAAAA
TCTTGGCCTAAGTTCCACTCCCCTCTCCTCCCTCCCGTGCCTTTATCTCATGTCTATGTTTGGCACTTGA
GGCTATGACCTGATTGCTCTTTAAACCTCTGTGTCATTGGGAACACTCACAAAACAATAGAAAGATGCTG
TCTTATTAGATTCCTGCTGAGTCCAGCATGAACCTTTCAGAAACTTGGTTATCTCCCCCCAGCCCCCACC
CCCGCCCCGACTCTTCTATTCAAAGAGGCTACACTGTACAGATCAGAAGATACGGTGACTTCATTTCTTA
GAGAAAAGTCGTAGGAAATCCTTTAAAATCCTCTGATCAGAAAAAGAAGCAGCCTAGAAGTTCAAATACG
AGGCTGAGTTGGATGAGCTACTCACTGACTAATACTAACTTTCTGATGGCACTTTTTAAACTTATTATTT
TGCAGTAACTATAGATGCAAGATGTTACAATAATAGTACAGAGAAGTACCTTGTACCCTTCACCTTGCTT
CCCCCAATGGGAACACCTTGCATATGATAGCATATAGTATAATATAAGTATAGTATAAACATTAGCAACA
CCAGGGAATTGCCATTGGTATAATCTCTAGACCCGAGCTCTGAATGATTTACAAATGGAGGCCCTAGCTGTAC
TTGTTTGTGTGTGTGCATGTACTTTATCCCATGTTTGTGTTCCTGTAACCACCATTGCCATCAGGATACA
GAACTATTCCACCACCTCCAAGAAACTCCCTTGTCTCCTGGCACTCATGTATCAGAAATCGCAGCAGATG
ATATTCTGCTTCTTGTCTGGGTCATATTCTGGGTGGATCTGTAGTGAGAGAGGTTAGCTAAATCTCTGAA
TTCAATCACTTGATTTGGCTGCCATGGAATCTGCATAACTGACTTACAAATGGAGGCCCTTGGTCTGACT
TGTAGGAAGAACATCTATAAGCCCAGAACAAAACCCCACAGGTTTGAATAAATAACCTCAACCTCATCAA
GGGAGCCTGTCAGTTGAGACCACTTGGTTTAAGAGGCTGTGACTAGTCATGTGACCTCAGTAGTTTACTT
CAAAGAATAAAACCCTTTCTGATGCCACATCACTTTTGGGACTTTATCAGTATGGGAATCCTATTCCGGT
ATTTCTTGAAGATGGCCGGGGAAGCAAATTCATGAGTAATGGGTACAGGGTTACCTCATCCTTGGATGC
ATTCCTTATAAAAAGAGAAGAAATTATAGGAAGATGCCCCTTTGTGGCATGGAGGGGAGAAACCTTTAGG
ACGTGCAGTGAGCGAGAGCTTAGGTGCAGGCTGAAAGAGAAACAGCTATAAACAGATTGAGGGAGAGAC
AACGGATTTAAGGGAAAACATCTGCCTGCATCTGACATCCAAAAGCTGCATCTGTGGCCGAGGATCAATC
TTGTAGTGCTTAAAAAGGAATGCGAGGGGGCCCAAAGCGGGCTCGGCAAGTTTCTTCTTTTTCCTCGAG
ATTTTCTGTTTGCTTTGCCCAGAATGCTGCCAGGCTCTGATGAAATAAACTCATGTGGTCCTGTTTCTTG
ATGCAGGAGAACCATTCGTTGTAAGCTAACTTTAGAATGACTGAAGGAAAAGACATTTCACCTGTATTGT
TCTAGATATACTCATCAGAGGAGCCCATTTACTTTGCTAAATGAAACTTCTAGAAATCTCCAGATGTATT
TCAAGTAGACATTTCAGTATTAAAAAGCTGGAAACCAGAAGAAAGGAGCAGATATGTTCTTTTTTTAAA
AAAATATTAGAGTATATTTGGTTTACAATGTTGTGCCAGTTTCTGCTGTACAGCAAAGTGACCCACTCTC
ATATATATACACACACACATTCCCTTTCTTGTAGTTCCCTTGCTGCAGTAGGACCTCATGAGCAGACA
GGTTCTCATGGAGCCTCAGAAGAGATTCAGAGCATCTCTGTCAATGCTAGATTGAACTTAAAATTTGTCA
AATAAGTCCTTGGCTTAGGTATTCTTTTTTCTCTTGAGTCACTTGTTTGTATCCTGTAGGCACAGAACAA
GAGGCTGGTTGAAAGGAAATAGAGATCAAGTGTTCCCCACAGATAGGCTAGTTCTCCATTTCTCTGAGTG
GAAGCAAAAGAGGATCATGGGTAAGGGCTTCAACTCTGCCTCCTCACCTAGTCTGCCCAGTGGGATGCTT
TACATTCCAAGATCATCCCCTCAGAGAACGTCACGGATGCAATCCATGCTACCCAAAGACCGCCATCCCT
GAGATGGAGGGAGTTGTCCTCCATTATTGTCCACAACCTTTGGGGATGTTTCACAGTTAAAGTACTTCCT
```

| Sequences |
| --- |
| AACTTTACCCTTCCCTCTCATTGTCCACGTGTGTTCTGTCTTTTTAACTCTTATCTTTATTTTTATACAT |
| CTTGCTCCCAACCAAGATTGCAATGAGATTCCTGTGTGCCATTGCCACATACATTTTGAGCAATTTGGAA |
| TTGCATCAAATAGGAATTAAGTGTGTGTGATGCTGTTCACTAGAGCTCTGTTCTGAATAATGATGACAAT |
| GGCCTCTGCATTTGGCAGCGTTGGGGAGGGGGAACGTTGAGTGAGCGTGGCTGATAATGAGGGAGGGTG |
| GCATCAGAGTGTCGCAAAATAGCAGTAAGAGATGGTCACCTGCTCTTTGTGCTCAGAATCCCTTTCTGAT |
| GCATAGACTCTCAGCATTTGTTGAAATAAATTGAGCCAGATATAGTATGTCCCTGTTTCCAGATTTCTC |
| CTCTATCATGTGGATGTCCTAAGCCCTGTGTTCTCCTCTATCATGTGGATGTCCTAAGCCCTGTGTTGAA |
| AATTAGGACAAGTTACAATAACATCAGCTAATTCACCTCAAATCACATAGGTTGAACGTGGTTTGAACTC |
| AGCTTTGAACCTGGTCCAAGTGTTGAGGAGACTTTTGGTGTAAGGGACAGACTCAAATTTCATTTTTTCT |
| TTCTTATGAGAAATCTCTAGAACTGTTTCATGACAACCGGGCGAGGACTGGTGCAATCTGAAGATCTCCA |
| TCGTAGAGTAGCCTAACTCAAAACTTGTTAGCTGGGGTACTCATTTCATGCTGTTTGCTGGGCATTTCTT |
| CCGACATTGAAAAGCACTGGTTGAATTTTTCCAGACAAAGCAGTTGACCTTAGGATTTGGCATCCTTTGA |
| GTTTACACCATAATTCAAATCCAAATCCTTTTTAAAAAAAGAAAACTGTATTACACACAAAAGGTGGCCT |
| GATAGTGAGGCAAAGAGTAATAACAGGCGGGGCAGTCTCAAATCAGGCCAGGGTGACAGGCTGGGACATC |
| TTGTTTTCATCAAGCTCTCATAGCTACCTCTTACTTCTCTGTGTTTGCTGGGCTTTTGAGATTCTGTTGT |
| GTTCTCTGTAGCTGGATGTTTTCCAGAGGGTCATCAAGAGAAAGGAGTATCCTCTGCATTAATAACCTTT |
| GGAAGGATTTTAGCAGTAAAATCAGAGGCTGAATGATCTGGTAGAGAATAGAAATAGGGCGGCGTTTATT |
| TCCCCTTCCAGGAAAGTGTCAAGTTCACCATACCCCAGCACCAGACCCTCTTCACCCAATACCTCTGAGA |
| ACTCGTATAAAGTTTACTCAATAATAGTGAAGTAAATGGCAAATCCACTACCCTCGTTTTGGGAATAAGA |
| ATTGTTCCTTTTAAAGGCATACAGATACAAAGTAAGTGACTGCAACCTCTTACTTGGGGTAACAGCTAA |
| TTTCTTCATGTTATGTGCTTTTCTGTTTCTTTGTTTTTTTGGGGGGGTTTGTTTGTTTTTTGGTGAATTC |
| ATTAATGTGGAGTTACAGAATAACTCTTGAATATTTACACTTGCTACCTTTATCTACTTATTGAAAAGAA |
| CAGATACTATATAAAAATTTAAAGGATATACTGAGTTGGGAGTTCCCTTGTGGTGCAGCTGGTTAAGGAT |
| ACGGTGTTGTCACTGCAGCAGCTTTGGTTTCTGCTGTGGCAAGGGTTCCAGCCCTGGCCTGGGAACTTCA |
| GCATGTCACAGGTATGGCCAAAAAAAAAAAAGTATACTGAAATGTATGTCAAAGATAAACACCATAGAT |
| GAGGAGTCAGAAAACTATGGCCTATGGGCCAAATCTAGCTTGCCACTTGTTTTTGTAAATAAAATTTTAT |
| TGGAACACAGCCGTACATCTTTGCTTATAGATTGTCTGTGGCTATTTTCCTTTTATAACAGTAGTTAAAA |
| TTAAAATCAAGAATGGATGTCTTAAAATATTCGCTCTCAGATCCTTTACTGAAAGTTTTCCAATCCCTGC |
| CACAGATCACCTCCATGATATCCATTCATTCATTCATTCATTTGTCCAGTTGATATTCATTTGTTCGGTGA |
| ACACCAACTCTGTTAAAGATACTAGGACACGCAGAGATGAAGAAAGCAGTTTCTAATGTCCAAGAACTTT |
| CCATGTGACAGAGACAATTCACAAACTCAGATGCCACCTCCTGCAGCACATACCATAGACCTAGAGAGAA |
| CTAAATTTTTGTGTAGTTCAGAGATGGCAGAGGCCCTGGACAAAGGGAAGGAATTGGGAATAAGCAAAAGG |
| ATATTGCTTTCATGAGTATGGCTCCCAGTGATTTCCCAGTGGGAACTTCATGAAAATAAGAGTCATTTCC |
| TTCATGGAACTTTATAAATTGCAGTGCCCAAAGGTGGAAATGATTTAGGATATTACTGAGCATCCAGAT |
| TTCTTTATCTGGAAGCATATTTCCCCTTTAACTTGGGGGATAGTCATATTTCTAGAAAATTTGTAAAGGT |
| TTGAAGGAAGGCTTCCTTTTTCAGGTGGGAAGACAGAAGGAATTCCTTTGCTTTTTTACTGACTGCTCCC |
| TGAGGAGAGTAATAGTAAATGGTCTGGGTCTACAGAAAGGATCTTAGCAGGAAACCCCTCAAATATCAGT |
| TGAATTAAAAATAAGGTAAAGTACAGACCTCAAGCCATGAATAAGCATGACTCAGTGAGTCTCAGAATG |
| CCACAGTGTGCCAGTATGAAGAGAACTCTTGGTGAAGGTTCTCGTCAAATGCCACCTCACCTGGAAGATT |
| CCATGCAGGAAGCCTTCTGGAATCTTCCAGTTAGGATTAATGTCTGTCTCTTCATTTGCGACCTGCTCAA |
| GGGCTGAGTTCATGCCCTTTTTGATTTTTGTATCAGCAACAGTGCCCACTCCACAGTTTCTATTTTCCAA |
| ATACCTAGTGATTTAACATGAGCTGAATGCCAACTGACACACCGTGTCTTCAAAATCTAGGTGGCCAATT |
| TTGTTGAAAGACCCTAGAATTGAAGGTTTATCTAAAAATGAAGCAAGTGAGAATCTGTCCATTCTGCTGC |
| CATCAGAGGATCAAAATGTTGGCTGAATTCTGGTCACCTGTGCTCTGTATTCATAGCAACAAAGTGACT |
| GGAGCAAGTGCAGCTGATTTTTTTATTATTACTCAATGAATTTTATTACATTTATAGTTGTACAATGAT |
| CATCACAACCAAATTTTATAGCATTTCCATCCCAAACCCCAGCGCATCCCCCCACCCCCCAACCTGTCTC |
| ATTTGGAAACCATAAGTTTTTCAAAGTCTGTGAGTCAGTATCTGTTCAAGTGCAGCTAATTTATGTTAGA |
| ACACAGCCCTGCGAGGTTTCCCCCACTAAAAGCATACTCTTTCAACTGATAAAGTGAGTGTGTTTGTTGA |
| GAAAGCTACTGAAAGCAAATGATACTGAATTCCAACTAGTACACTTTATCCTAGGAAGCATCAAACTGAA |
| ATATTTCCCATTTCCTCCCTGAGTAGGAGGGCCCCTGAAGTTGCCCCCCAACACCCAGACCCTAGCAGCA |
| TCCCCCTGGGGCTCCAGCCCCAGGTTGCCAAGATGCCCCAACTAGCCCTCAGTGTCCTAAAGTTTCCT |
| CAGTGCTCTGCCTTCACGGGAGCTGGGTGCCACTTCACAGGGGTAGGCCTCAGGTAAAGACTAGAAGAGG |
| GACATGTGTTCTGGAAGCTCATCTTGCGCCCCACCCCCACCCCAAGCCCAAAGAGGAAAAATCCATCCCT |
| TGCGTGTGAAGAGCAAGCTTTAGGGCATTTGCTGACAAACAGATAAAGTCGCTGCCTACACTGCTGGGTG |
| CCGTTTTCCGTCACAACTGGCCAAGTAAACACCGACTCTGCTGTCTCCTTCAGGCCCCACCGTATATTTA |
| TGAATGGGATCGTTTCCTCATTTTCTTTTCCTGTCAGTAGCAGGGAAGTCAGAAGGCATTACCTCCAAAA |
| TGGGGAAAGAACACTGCAAGTCCACACATTTGCAGCCATCTGTGGCAGGAGCCCCGATGTCATGGGCCCG |
| TCCCTTCGGGGTTTGTCCTGAGTTTCTGATTTATACCTTTTTACCCTCTGGAGGGCCTAGAAATGCTGAA |
| GTGAGATGGAAATGACTGATTAGCCTCAAGTTCTGTTTTCACTGGAGTCTTTCTGACGGCCTCTGATTCC |
| TTCCCCTTTCAAGCCCTCGGTGGCATGAATCCACTGGGTTTCTGCCCACATCACTGCATTCCTAGGATGC |
| CTTTCACAGGCCTTTGCAAGATCATCTGACAGCCGCCTGTGAGGTCAATGAACTTTATACATAATTAAAC |
| CTTCGCAGTGAGGAGAATTAATTTTTTTCCCCTCCCTGAGAAGCAGAAAACAGGACATGTTATGCTGCC |
| CTCCATTACTGAGGAAAAGTTCTGTGGAGTCATCAGGCTCGTTTCACATGATTTAATGCTGAACCGAATA |
| AGAAAGTGGTTGCATCCTCTACTGGGCCTCACAGAACAGTCACCACCCACACTGTTTATTCAGACTTGAA |
| TCTTGGCCATTTGGGGTTTAAGCCAGAAGAAAGGGGGGGGGGGAATCCAACCCTGGAATGAACGCTTTT |
| GAAACTCTGTATTCTTGATGAAATGCGGCCAAGGATTCTTTAAAAAATCTATTTAAAATCAATTACTGGG |
| ATCGTATTTTCATTTACAATGGATTGTTAGCAACAGCATATTTTCTCTGTTTCCATCCAGCTTTGGAGTC |
| AGGGCTGGAACTGGAATCCTCCCTCTGTTTGCCTGGGTATCTGATGCCACCACCCAACTATGTGGGTAAT |
| TGGGCAACTCTGACCTTTGACCAGCTTTCCATAAAATAACAAGGAAAGGTGTGAGGAGGCAAGGAATCAA |
| ATGAAAACAAGCCTAAGGGATTGCAGAAAGAGTGCTCCCCTGCCCCGGGGGAGGGAGGGACAGGAAAA |
| TAAGAGGCATCTCTCATATTAGAGGAAAGAGAAAGTAAAGGGCAGGACTGGGTATGCCTGGGAAGAGAGG |
| CCCCAGGACCATCTGCCAGGGTTGCAAAAAAAAAAAAGGAAAAGAAAGAAAAAAGAAAATCTCAGATA |
| TGTCAGATTGTCTCGGGTTTTTAAAGCTCTCTAGAGGAGATTCTGGAACGTCCGGCCGCTACCCACCCTA |
| CTCTTGGCGGTTCCTACAGCCAGGGCATTCTTATTTCCAGCCTAAACTGTGCACGTGGAGCTGCTTCAGG |
| GGCTAAGTTATTGATGGGACCGCCCCACCTCCCCAGGCACGTGTTACTCCGAAGCTGGGAGGGAGCCTG |
| TGAGTTGCTGATTGGTTGAAGCTACTGTCACTTTGCCCTCCATACCCAGCAGCCCCAGGGCGACTGGTG |
| GAATTGGTGCTGGGCACAGGATGGAGACTTTAAGAGTCTGGCACTGTTACCTGGCATTTTGTGTACGTCA |

-continued

Sequences

```
TCAGGAGGAAAGGACATCGCTGTGACATGTCCACATATCCAGGAATGAGCTTCACAACCATGTGCAACTA
TTAAGTATGAACCTCCGCTTTTGGATTTTAAGCGATCCAAGTTTTTAAGGAACAACTCTTGAAAACCAGA
AGGGAGATAGACTCTTGAATTTCACTGACCTCGAGATGGTAGGTAGTTCTGCTCCTCAGTTTTCTAAATA
AGAGCTCAGACTCTACGGGTAGCTGCTGTGTCTCCAGTTCTATCCCTGGACCAGGAACTCGCGCATTATG
TGGGCAGGGCCAAAAAAATTAGAGCTGAAAGCCAGAGAGCTTAAGGGACCAATCCTGGACTAGACATCA
GGTCTCATGCCCCCTCCCTGCCCCCAGTGTCCTGCCCTTCAGAGGATGGTGGTCTGGAGGCGAAGTGATG
CTGGGACTGAGGTCACTTTCTCACTTCCTCTGGCCCCTTCCGCCTCCCCGGCAGATGCGCAGGGAATGGT
CAGCGCCTCTGTGAGGGAGTTACAGATTCATTGAAAAGCTGTCAGATACCCCCGGGCGGCCTGGCTCCTT
CCCTTTTTTTTTTTTTTTTTTTTTTTAAATAAATCAAGTTATGTCATTGCCCTACCTCAGGCTGCAC
TTTGTTCCAGAAGGGAAGTGGTCGTCTTCCCTTTCATCCGCCCACCCCCATCTGCACCGAGTTGCAGTTC
CCTGTGCATATAAATTACTGAATGAGTGGAGTGAGCAGTGCAATTTGATGGTGAGGGTCTCGAGCCCTCA
AAGACTAAGCCCGGTGTCCACTCCTCACTCACCTTCCCTGTCTGTCTAGTGATAATAATACTTGTGCTAA
CTGCCTGAAGGGCCCCTAGGAATAAATGATAATATCTATAGATATCTTTAAAATATGCAAAACTCAGGGT
TCTGATATTGTGAAATATTTCAAGCAAACAGGAAATGTAGAGAATAAGATAGCAAATGCCTTTGTATCTA
CCATCGCTGTCATATCTTTATGCACTATTGGCTTCAGATCTTCTTACCTCACTTTAAAATGAGAGAGAAA
GAGAGAAAGAGCGTGCACTTCCTCAGTCCCATTCCTCTTTTCTGTTCTCTGAGCTTCACAGCTTCCATTT
AAATTTGGTCTCTATTATTACTAAGCATGATTGCATGTTTTACACATGTGTTTTTCCATAGACAGTATGT
ATATTTTTCACTGTTTTCAGTCTTTCTCTATACAATATCATTGGCTTTGGTGAGATTCATCTCTTGTAAA
ACATGGACCTCTGCTTCATCCATCCCCCATTCTGTGTGGTAGTCTATCAAAGGAAGGTCGTTACAGTTGT
TTCTAAATTTTAAAATGTCCATTTGAAGAATATGATAGAGGTTTCTAACTTCGTGATATTACAGATGGTG
CTACAACACATGCATGTTCTTTGCCTACATGTGGGAGAGTTGAGTTTTTCTTAGAGATAGAGATAGGTAG
GTAGAGAGACGACAGACATCTACATATGCAACATGCCCAGGAGCTAAGTGATAAAGTTAGAACATCTTC
AACTTCCCTGGATGTCGCCAAATTGCTCTCCAAAGTGATGGCATCAATTCACCACCATTGTGGTTTGAGA
ATTCCTACTGCCCCATATTCTCTCCAGTATGTGTCATTGTCTTATTTAAATTTTTCTTTTGCCCCATCTGA
TGGCTGTGTAGGGTTTAGATGTGATTTCCTGATTTCTAGTGAGGTTGAGCATCTTTTCATCTGCTTACTG
AAGTCAGCTTTCTCCCTTAATGAATTCTTTCTTTTTATCCTTTGCCTGTTTTCTTTTGGGGTGTTTGTT
TCCTTAATGATTTATTGGAGTATATGAAATGTTCTTGATACCAATCACTGGACTCTTATGTGCTTGGCAT
ATATCTTCTGTTGGTTTTGTAATTTTATTTTATTGATGGTATGCTAAGAGTTTTTCATTTTGTTTTAGTC
TTATAACAAGTTTGTGGGGTAAATACTATTTCTATTCCTATTTTATCAGTTAAGATAGTGCCTCTAAGAG
AGTTTAAGTAAATAGACTGAAATCTCACAACTGGTGGGGGGGGGGGCTGGATCAAATCCAAATCTGTCT
AGTTCTAGCGTGCTCTTTAAGACATAAGCACTGTGAATGTCCTCATTTTACAGATGAGCACACTGAGGCT
CAGAGATGTTCAGTGATTTGCTCAGCATCACACAGTGCAGTAATTAGTTCTGTGAACCAGAACTAATCTT
CAGGTCTCTAGATGGCTAGCACAATTGTATACCTGGATAGAAAGATGGGGGAAAGGAGGAAAAAAAATAC
TGCATCCACATATCCTTTTAAAATGTAGCTTTATAAAATGACAAACTATTTGAAATACAAACAAAAAAAA
AAAATTCACAGAATAACACAGCAACCAGTAGTCAACTCTGCTCAGATTTAATAAATGTTGACATTTAGCT
AAATTTTTAAAAGTTTATTTTATGCTGAAAATCTTACAGTTAAAGCCTCTTTTCTACCCTAACCTGATCC
CATTCCCCTCCAACTTTAATGGAGGTAGCCACTGTTGTGTATCCTATCAAAGTTGTATCGTTACACACAT
ATTGTTGCATTTATCTCCTGGCTGTGTGTCATGAACAATAACTAGTATTTTTGTGAGTTTAAAACATTT
ATGGTCATGTCTTTAATAATCCATCTTTCTGCAACTTGCTTTATCACTCAAAATTATGTTTTTAGGATTT
ATCTAGTTAATTGATGCAGAGCCAGTTTCCTTACCTGCTACCTCAATTCCTTTTATGAATATATCATAAT
ATATCTATTCTCTAATTGACAGGAGTTCATTTATACACAGTGCTGTTGTGAACTTCCTTTGGCTTATTTC
TCCATGTGGATGTGTGAGCTTCTCAAAGGTGGGGGTGCAGACATGGATTTCTGGGTTTTAGGGGACAGAC
ATCATCCACTTTGGTAGATGGTACTGAATTGCTCTCAATTCACACTTTCAGCAACCATGTATCAGAATTC
TTGTTGCTCTGTATCTTTTCCAACTGGGCATCATCAGGCTTTCACATTTTGCTAATATGACAGATTGAAA
GGTATCTTATATTGTGGTATTGATTTATATTTTTCTGATTTCTGGTGACATGCTTTTCTTTCTCATGATT
GTTGGTCATTTGGGTTATTTTTGGTGTATTTCCAGTTTATAGATTTTGCTCATTTTTTGTGGAGGGTTA
TTTGGTTTTTTTCTTTACAGATTACTAGATGTTTACTATGTATCTTATATACTTAAAAAAAACAAAAACC
AAAAAACCTCTCTCCATTTCTTGCCCTTAGCCTTTGTATTTTGGTGTCTTTTGTCACATAAGTTTTAAAA
TCAAATGGATCAACATGTCTTTTTGCCTTTTTTTTTTTTTGCTTTATGGGTTTGTGCTATTGTGTCAT
TCCCTAATGTGGGGTTATAAAAAATCGTCTATATTTTTTTCTTAAATATTTTAAAGTTACCAGTAATTCT
TTTGGAATTCATTTTTGGACGTAATGTGAGTTGAAGATTTGTTGTTGTTGTTTTTTTCCATATGAATAAC
CAGTTGTTCCAGAACCATTTAATAAATAGTTCAGTCATTTCCCACAGTTTTTTTTTTTTTTTTTTTTTT
TAGCTATTTCTTGGGCCGCTCCCGCGGCATATGGAGGTTCCCAGGCTAGGAGTCGAATCGGAGCTGCAGC
CACCGGCCTACGCCAGAGCCACAGCAACGCGGGATCCGAGCTGCGTCTGCAACCTACACCACAGCTCACG
GCAACGCCGGATCGTTAACCCACTGAGCAAGGGCAGGGACCTAACCCGCAACCTCATGGTTCCTAGTCGG
ATTCATTCCACTGTGCCACGACGGGAACTCCTTCCCACAGTTTTATAATGCTACTCTGTCACATCCCCAG
TTCCTACATGCAGAGGGGCTCTCTCTTATGTTGGTCTACTTATCTATATCTACACCAATCCTATTGTG
TCTTAACTATAAGCCTTTTTTTTTTTTTTCTTGTCTTTTTAAGGCTGCATCTGCGGCATATGGTAG
TTCCCAGGCTAGGGTTCAAATCGGAGCTGTAGCTGACGGCCTACCCCACAGCCACGCAACGCAGGATCT
GAGCCACATCTGCGATCTATACCGAAGCTCACAGGCAACGCCAGATCCTTAATCCACTGAGCAAGGCCAG
GGATCGAACCCACGTCCTCATGGACTGGGTTTCCTTTCCTATTTTTCAGATTGGGTTTGTTACTGCTGAG
CCAGGACTCAAAAACTCCTTGGCTGTTTTTTTGACCTTAATTCTTCTGTATGAATTTTTAAACCAGCTAA
AAATGTCCATGAAAAACCTTTCTGAGACTTTAATACGAATTATATTCAATTTATGTAGGGAAGGAACTAA
TGTTGGTGTTGAGTCTTCTCATCTCTGAGCATGATATATTGCTCTATTTAGGTCTTATGACTTTCAGTGA
AGTTTTATAATTTTCTTTCATTTAACTTTTGCACCTCTTTCTTTAGATTTATCTCCAGGTTTGTCATACT
TTATTGCTATTGCTTACAGGATCTTTTAAAAGTTACATTTTTAATTGGTTGTTGCTGATAAGGATGCCAT
GGATATTTGCATATTAATCTTGTTTCCAGTATTCTTTCCAAACTCTTTTGTAACTTGTAATTGTAGTTTC
TCATGGATTCTCTATGTAGACAATCTTATGTGTAAATAATTCTTTTGCTTCTCCATTTCAAATTCTTATT
TCTCTTACTCCTTTTTCTTGTTCTATTGTATCAGCCAAATATGTCACATGACAGTGAATGGAGTCGTGGT
AGAAAAAGCACATTTATCTATGTCCTGATTTTAAAGGAAGTATATTCCTAAAGTTTATTTTAGGTTCTTA
ATAGAAACTACTTAGTAAAAACCTTCTTCTATGCTTGGTTGTCTAGGTATTTTATTGTATTTTTAAATTT
TGAATAGGTGTTAAATTTTATAAATGTTTTTTCTTCATCTATTGTGATGATCAGTTTTTTCTTCTTAATA
TGTCAGTGTGGCAAATTATAGCAAGACTTTCTAATGTTAAATCTTCCTTGAGCTTCTTGAATAAATCTTA
TTGGATCATCACATACACACACCCATGCATACTATATACTACCATGTGATAAATATATGTGATTATGATA
TATGTGATACATTATAGATATCATATAAAACATTTATTTTAAAATAAAiGTATATTTATAGACATACTAC
ACTTCTAGGTATGATTGCTAAGATTTTATTATTTGTGATCATAATATTCTATTTTTTGGCGTATCAATTT
TTTTGTCTTTTTTGTCTTTTTAGGGCCACACCGCAGCATATGGAAGTTCCCAAGCTAGGAGTCGAATGGA
```

| Sequences |
| --- |
| GCTGTGGCTACTGGCCTATGCCGCAGCGACAGCAATGTGGGATCTGAGGCACATCTGTGACCTACACCAC |
| AGGTCATGGCAACGCCGGATCCTTAACCCACTGAGCAAGGACATTAGTCGGGTTCGCTAACTACTGAGCC |
| ATGATGGGAACTCCCCGGTGTTTTAACTTTGGTAACATACTTTTCTAGGAAATTTTCCATTTAATCTATT |
| TTTAGTTTTATTGCTTTAAAGTAGAGAATAGAATTATCATACTCTAAAACAATCTTTACTGTATTTATAG |
| TTATGGCTCCTTTTCATATCTAAAAGTGTTTATTTGCGCCTTCTTTTGTTTCTCTTGCTCATTCTTGTTG |
| AGCACCTACCTACTTTGTCTTTTTATCTTAAGAAAATCCACATTTGTTCCTATGTATATTGCTTCTTTGC |
| TTTTATTTTACTGATTTGTTATTATCTTTATCATCACCTTCCTGCTACTTTATCTTTGTCCATTTGTGGA |
| AAAAGAATTTTTTTCTATTGTCTTTGAGTTTATTTTATTGCTTAATTTTTTTGTTCTTCCTAATTTAAAA |
| TGTTTCTTGTTTTCTTATATTGCATTTAAGGCTAAAACTCCATCTACTAATATCTAGGGTTTTAGTTATT |
| GTTCAGTTCCAAATAGTTTGTTACTTTCATTTTTATTTTATTTAATAATTTGACAGTGTGTTTTGAAAT |
| TTCAAGATGTTCTGGGGTTTGGGGCCTGTGGTTTTGTTACTGGTTTCAACTTTTATTGTATTTTTGGTTG |
| ATGAGTGTGGTCTGAATGTTAGCAATTCTTTGAAATTTGTTGAAACTTGCTCTGTGGCCTAGAACCTGGT |
| CAATTTTTATAAACATTTCATGTGTATTCCTTATTTATTGAATGAAGGGTTCTCTTCACAGCCACCAGAT |
| AAAGTTTGTAATATGTGTTATTTAAATTTTTTCCTATTTTTTATACTGGTCTGTTGATTTCATAGAGGTA |
| TGTGCTAAAATCTCTAACTATAATCTTGAATTTGTTACCTTCATATAATTAAATCAGTTTTTGCTGTATA |
| TATATTTGACCTGTGTGGTTAGGTATATGGAAGAATTGCTGGTGAATGTATCTTTGAATCTTTAAACAGT |
| GATCTTCTTTATCACTCTAGATGCTTTTGGCTGTAAAGTATATTTTATCAGATTAAGTCATTCAATTAAA |
| ATAAGTATTTATTGAGCATTTACTATTTGTAGGGACACTTATTATCAGAAACATTTTTTCCTATTTACTC |
| TTCCTCTAACATTATATTTTAGGCTTCTCTCTTAAAACAGCCGGCATTTTACAAAATTCAATCTGAAGAT |
| TTTTTCCTTTTAATGAATTAGTTTAAGCCGTTTACATTTATTAAGTCATGTATTTGGAATTCACTAGGA |
| ATCCAAATGTTTTCTGCTGCCATGCTTCTTGTATACTTATTTTTTTTCTTCCTGTCCTGCCTTCTGTTAG |
| ATTACTTGAATTTCCTTGTTGATTTTGCATCCTCTTCCCTGTGCCCAGTCCTTGGTCCTCATGTGGCAGT |
| AGACCCCCAGCCATGGCCATGCTCAGGGCCCAAGCACAGATGGCTATGTTTCAAGAAAACCTCTGCAAAG |
| ATAGAACCTGCTCAGGAGCTATTTCCTGAAGAAGATTTATGGATGCACTTTGGAAAGAAACAGCTCTCAA |
| GAAGCCAGCCTGAGTTATCTGAAGGCCCCATTGGACATTCTGGAGCCTATCCAGTCCAGAAGAAACAGGA |
| AACATGCAAGAAACAGCAGGATAAGGAGGATATGGATGAAAAGACAAAAAGGAAAGATGAAAGCAAAGGT |
| CCTCCGGGTGGCCCAGTGGATGTCAAGGAGTGGACTGGAGTCCTCCTATAGTGCCTGAAGCTGAGCAGTC |
| ACCATGGTCACCACCTGGTTGCAGCTGCACATACCTCAGGCTGAAGATGGGAAAGTATTGAAGAAGATC |
| TTTGAACAGATGAACAACCTTCACACCAAGCTAGAAGGCTTCCATAGTGAAGCAGAGCACCAGGACCCTA |
| CCAGTGGTTGTGGGGACCCACTAAGCTGTGTTGTATGATGTCATTCGGAAGAATTTCAAGAAGCTCAAGT |
| AGCCAGGGGATAATCAAATGGAATGATGTATTGAGACCCTCCTCTCATTCTGTGATGGGTTGAGCAGAGA |
| CATCCTTGCCTCTTAACAGGGGCTCCAGACTCTCTCCCATCTTTTTCCTGTTGAGGTTTCTCCTTCATCT |
| TGCCTCCCAAGCACAAAATGTAGTCATACTGTTAAAACAATGATTACTATTTTCCTCTTGATTTGTAAT |
| GTATACAGTTTGTTCTGTATCTCAGCTGTTACCCTTAAATCTTAAAAATTATATTTGAGTTCACAAACTC |
| TAAAATTAAAGCATCGTCTGTATCTCTATTTGCTTCCCAAACAATGTAATATAGATTCCTTAGAAAATTT |
| TAACCCAGCTTTTCTCTCTCTATTCTAATATGACACCATCAGCTGTTTTATTTTCATCTATCATTTGT |
| TTCTAGTTGTTTCGTCCATGTAAAATTGTTTTTACAAACCTACTTTTTAAAATTTTTGAGGCATCTAAAG |
| AGATGCCATTTTGGAGTTCCTGTCATGGCTCAGTGATTAACAAATCCAACTAGGAACCATGAGGTTGTGG |
| GTTCGATCCCTGCCCTTGCTCAGTGGGTTAAGGATCCGGCATTGCCGTGAGCTGTGGTAGGTCACAGG |
| CATGGCTCAGATCTGGCGTTGCTGTGGCTCTGGAGTAGGCCAGTAGCTACAGCTCTGATTAGACCCCTAG |
| CCTGGGAACCTCCACATGCTGTGGGTGCGGCCCTAGAAAAGACAAAAAAAAAAAAAAGAGAGAGAGAGAT |
| GCCATTTTATTGGTAAGAGTATGAAATCCAGAATGAGACTGCCTTGATTGAAGGCAGTTTAATTGTAAA |
| TTACTTAGAATGGTGCCTGGCATGCAGTCAAGTACATAGTAAGCCCTTGATACATATTATTGATATTGTT |
| TCTCAAAGTTTGTCCCCCCCTTTCTCAGGTCAAATTCCTTCATACTGAAGTACATCCTTAAGTAGTTCTT |
| TCGTCAAGGATTTAGGGAGTTGAAACTATCTCACTCTATCTGAAAATATCTTTAATTCAGCTTTAGTCTT |
| GAATAATAATTTTCTAGGTATAGAATTCTACATAGATATTTTCCCTCAGCATTTGAAAATATTGATTCAT |
| TGCCTTCCAAGATCTTTATTGATGAGGTTCAGTCAGTGACAATCTGTTTTTGTTTAGAGGTTTGGGTTTT |
| TTTTTTTTTTTCTTCTTCTGATTGCCTTAAAGATTTTTGTTTGTTTTTCTTTTTGTTCCTGTCTTTGATGA |
| TCTGCAGTTTCACCACAGTCCTTTTTGGGATTCTCTTGAATCTAAGAATTCCTAGTATTCATTAATTCTG |
| AAAAATTCTGTCATAATCCCAGAATATTGTCTCCCACAGTTTTGTCTATTTTTTCCGTCTTCTGTTGTTT |
| GTTATTAGATCTTATTTTTCTCTTTTTCAAGTCTCTTAACCTGTATTTCCTACATCTTTATTTTTCTGTG |
| GTCTATTTTTTTCTTAATTTCCTCCTACCATTTCTATTCTTGTTCTTCTAAGGTGAGCAAGGTGAACATC |
| TAGTAGGCATCCTTCCATATGTTTTTCCAAGCTGGTATAAAAGTAAGACATTTTTTTATAGATTAAATA |
| ACAGAGTTTTGGAATTCTCTTGTGGTGCTGTAGGTTGGGGATCCAACATTGTCAGTGAAGCAGCTTGGGT |
| TGCTGCTGTGGCATGGGTTTGATCCCTGGCCCAGGAACTTACAGTTTTTTTGAGGACAGACAAAGAAAGA |
| AAGAGAGAAAGAAAGAACAGTGTTTTGTTGTTTGCAAAACATTCAATCATACCTTGTGCATTACTTTATA |
| ACCTGACTTTCTCTCTTAATAGTACATTAAGGATCTCTTCGAGATAAGTAGATAAAATTTAATTAAAAAA |
| AATAGCTAACCAAATCCTGTGATATGGCAGTACTACAATTTATTCAGCCTTTCCACTATTGGTGAACCTT |
| TAGGTTATTTTCAGTTTTATGTTTGTACAAACATTGAAAACATGCTCCTACATATGTACTTACGTGCTGG |
| TTCCTTAATTTCTGTGGGAACAAATTCTACCTCACCTGCTTCGCCTGCCCCCCCCTCGCCACACTTCCCC |
| AAGAACATCACTTTCTCTATTTTAGCTCTTTCTTCTGTCATTTCTAAATGATGTGGTATGCTGGATCTT |
| TTGCTTTATCAACTTTACTCATGAGGTCTTAACTTCTGATTATATAAATGCAAATTTAGCTCTCTTACAT |
| ATCCACTGCTTTCCCAACCCCTTTCTCTTAACATAATTATATTGCAATATTAGGTTTTATCAGTTGTTAG |
| TGTTTTTGCTCTTTGGCCCATGAAAATAGCATTAACAGTCAAATTTTTTGTTTTTATGAAGTTAATATCT |
| GTCTTGCTTTTTCCATTTCCTTAGTGTTCTTCATCCTTGTGGGAAAGATGTTCCCTCTATTATTTTTTT |
| AACTGACTTATTTGGGTTTTTCTTTTCAATAAATTTTTATTATATTTATAGTTATACAACCATCATCAC |
| AACCTAATTTTAGAACATTTCCATCCCAAACCCCCAGTCCACCCTTCCCTCTCCCCCCACCTATTATTTT |
| TCCTAGTCTCACAGTACAGTTTTCCACAAGGCTGATCACTCAGAAATTTGTGAGGAGGTTCTCTTGTGGC |
| ACAGTGGCTTAAGGATATAACATTGTCACTGCAATGGCTCAGGTTGCTGCTGTGGTATGAATTCCATCCC |
| TGGCCTGGGAACTTTCACATGCTGTGGGCATGGTCAAAAAAAAGAGAGGAAAAGAAATCTCTTAGTTCTC |
| CTTTTCTTGGCAACATTCTTCTGGAGACTTCCATTTTCCTTTTATCTGGAATTTTATCTCAGGCCTGTTG |
| CACAGTTGTCATGCTGGACTTGCTCTTCCTTGTTATTCTAGAACTTTCCTTGGCCTTTCCTTGGCCTTTC |
| CTTCCTTGTTATTCTAGAACTTTCCCCTCTCTTGATTTACTCCACTGTTTTAGAGAGCAAACTCTCTGAC |
| ACGCTTTCAGAATTAAAGCCCCGTGCGCTGGTGGAGGCCTCACTCTGACTCTCTCCTGATTCACTGATCC |
| AGGCAGTTCCCTTCTCCACCTAAACCCTCTGCTTTCATCCTGTTAGGTCACATCAAGTTCCACTCACCCT |
| TTTTTTTTTTTTTTGTGGCTCCCAATCTGCAAGCAGCTTTTCAAAAGTGGATGCAAGAAAGAGAGATT |
| CATACTTTGAATGTCTAGGAGGTTTTTTGTTTCATCTTCTCACTGGAAGGCTTATCTGTCTTGCACAAGG |

| Sequences |
| --- |
| AATTCTAGGGCAAAACTAAATTTTCTTCAGTGTGAAGACATTGCTGTAGTGTATGCTACCTCCCAGTGTT
GCTGTTAGAAAGCTAAAGCCATACTGATTTTTGATGCTTTGTACCTGACCTTTTTAAAACATTTCTCCTT
GGACCTTGTAGAATCTTTTCTTTTCCCCAGTATTCTAAATTTCACAATTTTCCTAGTCCGTTTTCATCTG
TTGTACTGATTAATCAGTGTGTTCTTTCAATCTGTCAAATTCACTTCTCTCCGTTAACTCATCTTTCTTT
CCAGAACTGTGGGTGTTGTACTTTCTAGGCTAGTCCTCTAATTTCTTCTTCTATTTTCCATCCCTTTATC
TTTTGCTCTCTTTGGGGGCAGTTTCTTTAACTTCAATTTCCAACCTGTCTATTGGGTTTTCATTTCTGTT
ATTGTTTTAAATTTCCTCTTTTCATCTATAAATAGTCTTTTTTTTTTTTTAAGCATTCTGTTCTGTTTTC
ATGTGACAGTCTCTTAGCTTTCTGGAAAAAAAATTATCTTGAAATTTTCTTCTCCCTTCATGGCTTCTAT
TTCCTCAGTGTTGCCTTTTTGTGTTTGTCTGTTTTGAACTCTTTTGTTTCAGGTAGAGGCTTTCCTTGCA
TATCTGGTAATCCTTGACTGGTCATATTTAAGAATGAGGAACTAATAAGTTCATTGGAAGAGCTAATACG
TTTATTAGAAGAACTCATAGGTTTATTGGACATTTACTGTGGGCTCTGAAGATGTGTGGGGCTTGTTGAC
TTTGAGCATTTCCATAGAATAATGGCTTAAGGCCATTTGTTGGGAACTCCTGAAGTCTATGAAGAACCTA
AGTGTTCAGGGAACACTCTTCCAAAGTCTCCTCTGGAGGGTGAAGCTCTGCCTGCCCCAGTGCAGAGAGC
TAAAGTGAGGAGTCAGGCTGGAGGGGTCAGCATTTGATGTGCATATTTTCTGTTTTGTTGGATGTGTGGC
AGCTCCCAGTCCAGGAACCCTGTCTCCAGAGTTCAGCTTTACCAGTTGGGACAGAGGCTGCCACCCAGCG
AGGTGGACCTAAGGAGGGGATCTGGGGGCAGAGGGAGATAACTGGTTCTTAAAAAACTTTCGTCTCATCT
CATTTCAGTCACTCTGCCCTGCCCCAGTTCCAGAGGTGACTAGTGCTGTCTGTTCCTGGACCTTTGCAGT
CTCTGCTGGTTGGTTCCTAACTTTTCTGACTCCTGGTTTAGGATTCTGACCTCTTTGTTGTGCTAGTTCT
GTTACCACTGCTCCATCTGTTTTCCATCTTCACAAATCTTATTGCTGCTACCCCTTCACCTGTTCTCCTA
GTCCTGGTGGGTTTATGTCTTTTAAATGGTCACCTGGCCTCATCATAGTGAGGTTTCAGGGTGACCAATA
TTAGATACGGTGTGTTCAATTTTCCATTGTTACTTGGAAGTCCTATGTTATATTTTGGTTGATTTCCTAA
AATCTTTTTTTCCAGTTCACTCATTCTATACTTGTGTCACTTTATTTTCTACTTTTCCATTGAGCTATTT
TTAGGAGTTCTATTTTGTCCTTTTTTCAAGTCTGCTCTTTTCTTTTTCTTTGTTATTTACTCCTATTCTT
TCATTATGCTTTTAGTCTTACTTTTATCATTTTAATAATTTGAAGAAGTCTTATTTTGTTGTCCATTTC
AGATTACAGTATTTTCCCAGCTCTTAGATTTTAGTCTAAAAAAAAAAAATCTCTTTATGACTGTCCATCAT
GGTAGTTAACTCCTTTATATGGTATGTGTGTGTTTGTGTTTTGGCAAGTTCATCTTCACAGAGATTTATT
TCCAGTGGGAATCTTGTGAATCCTGAGTTATGAAATTGTCCCTATGCAGTGGTCATATGTTTGTTTCTTT
TGGTGATTGAAGGAGTTTCAGTGGTCCTGAAAATGTATTTATATTCACTGCTTGTCTCACACCCAGACAC
ACCAATAATGTAAATTCTGATCCTACAATTGAATGGGATTCATGTTTAGGGTTTTCCTTTCTCAGAAGTG
TCCAAGCTCTGCATTTAAAACAGTTATCTTCTTTGGAGTTCCTGTCGTGGCGCAGTGGAAACGAATCTGA
CTGGGAACTGTGAGGTTTCGGGTTCAATCCCTAGCCTTGCTTAGTGGGTTAAGGATCTGGTATTGCCATG
AGCTGTGGTGTAGGTCACAGACGTGGCTCGGATCTTGCATTGCTGCTGCTCTTGCGTAGGCTGGCAGCTG
TAGCTCTGATTAGACCCCTAGCCTAGGAACCTCCGTATGCCATGGGTGTGGCCCTAAAAAGACAAAAAC
AAAAAACAAAACAAAACAAAAAGAAAGTTATCTTCTCCATCTTGAAGCCGGGGGTGGGGGCAGGGGAC
AGTGGTTTTGTCTCCTTTCATGGATAGTGTGACTTTTTAAGGCTTTGAGATTTAGGAAAATAGTTCGCT
CAATCCTGCCTCCCTCCCCCCACCTCACACAGGACCAAGGCCACATCTCTTCATGGGCGTTAGAATCAGA
CTGCTGTCCCCAGATCCCCAGAAGTATTTGTGCAGGTCTGAAACTTCCCTTGTCATCATGAAGTCACCTT
TTTGTTAAAGCTCTGACTTTAATTTGATCTTCATTCCTGGAGCCCATACTTCTCTCCCTTCCTTCTTTCC
CTCCTAGCCCTGCACTGTGATTTTTTTCCAGAACTTCCCATTTTTGTAGTGGAAAGGGACCATAGGATC
AGCCCAATGTTTGCAATTTTTCTGGAAGTTAACACTCACATCCTCTATGGAGCTAAACCTGTAACATAGT
AAACAAAACCTGGAATCGACTCTAAAGGGCCAGAGATCAAAAGCTCCTGAGATATCACTTCATCCAACAC
TAGCATTTTAGGAAACTTAGGCTTAAGTCTGATGAAACTACTTGCCCACAGATACATGGCCAGTGAGTGG
AAAAAGCTGAAGACAGATCGCAAAAGGTAGCCACCTTTTTCTTATTACCACATCACAGGAGAAGCAGCGT
CATCAAGCAGCTAGCTGTTGTCTGGTTGCAAGACTCCTCAGTGTGACAAATGTTCTGCCTTAAATTACTG
TGAGATTTCGGGAGATTGTGTTGGTTTTGTGTTGTTTTTTAATCTTGGGGAATAGAAAGCAGTAATCCCC
ACAGAATCACTTAGATGGTTTTTCTTCTGTCCCAATTTTTTTTTTTTTGCTTTTTAGGACCATACCTAC
ATGGAGGTTCCCAGGCTAGGGATTGAATTGGAGCTGTAGCTGCTGGCCTACGCCACAGCCACAGCAACGC
AAGATCCAAGCTGCTTCTGTGATCTACACCACAGCTCACGGCAACATCTTAACCCGCATGAGTGAGGCCA
GGGATCGAACCTGCGTCCTCATGGATGCAAGTCAGATTCGTTAACCGCTAGCCACAACGGGAACTCCTC
AATTTTGTTTTCTTTTTTGATTTTAATTTTTCCAAAGAGTAATGCATTTTCCCCTCTCCTTTCTTCATTT
TCTTTTCTTTTCTTTTCTTTTCTTTTCTTTTCTTTTCTTTTCTTTTCTTTTCTTAAGACCCAATT
CAGGTTCCATGATCTCTCAGAAATCTCCCCTGAAGTCTGCAGCCCATCAAGGGTTTTTTCCTTCTCTAAC
TGCTTTTGACATTGTCATTTGAATCACCTAATTGGCCCCCTATTATAAATCTGTCTGACCCTGTTTAATG
ATTGAATGTGATGTACTTGGTCTCCTCAACAAAATTGTAAGTGCTAGTTTGCAGAAACCGTGCTTAGACA
TCTTTACCATTTCCCAAAGTGCTTTTCTTGATTAATTGATGAGTAAACAATTTAGAGGGAAATATGTTCCC
TGTGATAGAGCCTGGGCTTGGTGTCAGGAAGCCTGGATTCTGCCCCTTTTCTCGCCATCAGTTCCCTGGT
GTATTTGAGCAAACCATCTTGCCTTGTATGAGCAGGCCACTGTAATCTGGCAATTAGATTGAGTGGTCAT
GTATCTTAGCTTTCAAACAGGGACAGTTATGAGAGCAAAAGGGGAAGCACTACGAATAATTTTACAGGGA
CAATGGGTGTAACCTGGGACTCTTCCTGATGAGCCAGGACATATGGTCACCTTATGTCACAGATCACCTT
GAGCTCTTCAGAAAATTCTGCACAGATGCTCTCAAAATACCAGTCTTGAAATTAAAAAAAAAAAATTATC
ATCCCTTATAAGACCTCACGGGTAATAAAGTGTTTTGTTTTCCACGACGTTCATATTTTCTCAACTACTT
TCCTGGCTTTAAATGCTTATTATAACTGAAGTTAAAGAAATTATGGGTTTGAGAATTAATATTATTAAGA
GAAAAATGCCTTTATTTTCCATGTCAACACCACTCTCTGTCCTGGAAGAATTTTCAGAATTCTGAGCCTT
GTTTTCTTGGGTGCTTTTTGAAACATAAGCTCTTACCTCCAGTATAACCAGTGATGGAGGAAAGGTCTGT
GAATGGTTGTTGATCCCCAAGACTGGGTATGTCTTCATGTAATGGTGTGTTCAGTGGCTTAGCATAGTAG
GTGAGGTAGATCTTTAAAAAGACACATTATAAATACTATTGCTCACTAGCTGCTCATTTCTGCAGCTCT
TGCCAGAATGCTCTGTACACAGCAGGTGCTTCATAAATGTTTGTTGGCTTCAAATTCCAAGGAACACTTG
GAAGACAGTGGTGGCTAGTAAATTCATTTACCAGTGCTGGTCGCTTCACTCCTGATGGTGCTTAGGGAGT
ACTCTGTGATGGGGCACGGTGTTGGAATGCAAAGACAAACAGATACTATCTCTTCCCTCTGGGATTTTA
TGATCTAGAGACAGTCTTAGAGCTGTAAACAACACAGTCTAAGAAAGTTCAAGGAAAAAATAAATCAGT
TTTGACCTAGGGGAGTTAGGTGGCATTTGAGCTAGGGTTTGAAGGAGGTAGGCTTCTACTCTAGAACAGAGG
TGGATGAAGGCCATTTCATACAGTGGCAATGGCACAAACAAAAACCTGTAAGAGTACAATTGCTTGGAAT
GTATAAGGAATCTTGTATAAGAGGTCTTGTGTGTCTGGAAGATAAGATTTAATAGGTGAGATGTCCTTTA
ATGTCAAACTAGGGAACTCGGGTTATATTATGTAGACAATGGGAATCACAGTTTTGGATTTTTGCAACCA
ACTCATGTGGCAGAATGATAACCTGGTTGCAGGGAGACCAGTAATGCAGAGGCTTTGGTGTCTAGGGGAG
ATAGAAGGTAGCCAGATATGAGATACAGAATTAGCATGTAGAGTTTAGGAGGAGATAAGACCCGAACATG
ACACCAAAGGGATGAGAAGATGGTGACGCCATGATGAGACCATGGAAAGTTGGAGAAGAGCAGAACTGGA |

| Sequences |
| --- |
| TTGTTAGGGAGCTCTTGAACTCTAGGGAGCTTTGTGAGACTATGTGAAATAGTGCATAAAAAACCTTAAC |
| TGATTCTTTGAATGAAGTAGATGTTTGATAAATACTACATTGAAGGAAGAAGGGAAGGAAGAAAAGAATG |
| GGAAGAAAGGGGTCTTTCTCTCTGTGCATGAGGCCAAAACAGGGAGGATAGTTAGGGGTTTAGGAGATCC |
| AATGGGAATCATGCACTGGGCTCTTCCTGTCAAGAACTTGCCAACTACTTATGAATTGAGTGCACAAACC |
| AGGAGAGGACTCAGAAAGAATGAATGACCCAAGTTTGTTGGGGTCAGATAGGGAGAAGTAGGCTTTGAGC |
| CAGACTTGGAAGAAGTGAGAGATGTAGGGTGATGGAGGGTCCACAATGAGCCAGAGAGGGTAGCCTCTCA |
| GGAGGCAGGAAGGGAACACACCACCCACATGGAGAATGGGAAGGATGCTGATTAGCATCAGAGGTAGTTT |
| CTGCAAGTAGAGAAATGTCATGGGTGAGCGATGGGGGCGAGGGGGTCATCTGGAGGAGGCTAGAATGTTG |
| CTCACTTTCTGACAAGCCTACCCTGAAACTGTCTTGGAGAACCCTGTTTCTGTGTGACAACCAGCCCAAT |
| GCCTCCCCAGTTTTCTCTGACCATTTGGAGTAATAGCAGGGCAGTCCTTTGTGTGATCAGAAACCAAGTC |
| ACATAGACTTTTCCTGATGAGCCATTTCAAGATCACTCTCCCTAAATCCTTTTATTGGAAGTACTGGTCA |
| GTGCTTTGTCTTGCAAAAATGCCTTTTGGTTTCTTTCCCTTTGTCTTTGATTATTGGATAAACATTTTAG |
| TTTCATGATTACATAGTGTTTAGATGGGGCAATTCATAAATCGGCATTACTAAAATTGTTTGCCTTCATT |
| TACATTATATCAGTCATATTACATCTGCTTCAGGAATGCCAGAAAACATAAACATGGCTTATTTTGTAAA |
| CTACCTCAATTGGAGCATCTGAGAGAGAGAGAAGGCGTAAAATGTGGGAGTTGGCATGCTGTCTCCCCTT |
| GAGTAGGAGAATCTTGAAGCCAGGAAGTTCTCTGGAAGCCTTCTACTACCACCTTCTTAAACCCGGTGCC |
| TCCCATCCTCTTCCTGAATTCTTCTAAGGAAGGAGAGTTCTCAGAATGTGCCAACTTTTAGAGAAAGGCA |
| AACCACAACCGAATAAAACGTTAACATTAATTTCTCTTAACACTAATCTGAAACTTGTTCAGGTGGCTAC |
| AGTATAAAATGGATGAAAGCCAGGAGTGACCTGGGGATACTGTCATTTGATCTACAAAATCCTAGTGTTT |
| GCTGGATGCAGTGCTTATCAGTGAGGTGTGTCTTTTTTTTTTTTTTTTTTTTTTGTGGAGGAGAG |
| CTTTTCACATCTTCTTATCACATAAGTTGTCTTCATCTTCTATGGTTTTCCACACTTTGGTCTTTTCCCTT |
| GGATATTGTATCTTTCCCAGACATGGCTTCCAAGATGTGGCTGCATTTAGGGATGCAATATTAACAGTGG |
| GTTGGTCTCTGTAATTTTGGACGAAATCACCTGTGTTTTGCAGGCATCCGTATAAAGTTTACAAAAGGA |
| CCCTGAGACTTAGCTGTTCTTCTGCATCAGTGTTTCACTTATTCATCCCTTCCTGTAGAAAAATCTGACG |
| CCGACTGTGTTCCTTTCCATTTCCACCATTTACTCTTCATTTGGGGCCATTATCAATGCTCACTGATACT |
| ATTACTTCAAAAATGGGTTTTAATCTCTGTCTCTGGGGGCATGACATAATATCCCCAAACATCACCTTG |
| ATCCTTACTCCCTCCTCCTTAAAACCTTCATGGCATAATTTTCAAAATAATGTATTTTTTTGTTCTGATT |
| ACAAAAGCAAGATATATGTGTTTTTTTTTTTGTTTTTTGGTTTCTTTTTGGGTTTTTTTTGCAGAAAA |
| TTTTAAAAATAGAGAAAAGCGAAAAGTAACGAAAACATCACTTGTAATCCACCACCAAAACAATAGCCTA |
| TTGTTAATAGGTGGTACACATCCTATAAGTGTTCTTTTGTCTTTTCTAGCACTGAGAGCCTTCCTGGTC |
| TGGTCCCAGCTTGACATTACAATCTTCTCTCTAGTTCCTTCCTCTCTGGGGACCTGTATTACCTTGCA |
| TAGAACTTTTCATATTCCTCCCACCCCAGTGATTTTTTTCTGACTGTATAAACAATACATATTGTTCTAA |
| ATATTTTAAAAATACATTTAAGAAATAAAAATTTCATTTGAAAACATCTTAGACCCTGAAATAAAAACCA |
| CTGACGTTTTGCAGACTACCTCATCATCAGCTGTTTATAGATGTGTGCCTAAGCTCACACACATGATTTC |
| CTATAAGTGAGATCGTGGCATCCATGTGGTTTTTATGGTTGATATCTTCTTTCATTTTCGTTTATTTCTT |
| TCCTCCCACTCCCTTCCTTCCCTCCACCCTAATCCCTCTCCCCCTTGCTGCCAATGTTATTGGTCTTGTG |
| TGTTATCCTTCTGTGCTTCATTCCACACTCATATAATTATACCAGACATTTAGATAGATAGGTAGATACT |
| ATGTACGTGAATTCTGTCATTGCTTTAGAAAAATCAGACCATATCATACGTCCCTCTCGGCATCTTGTGT |
| CTTTTTCACTTCACAATGAAAAGAGAACTTCACGTTGTTGAAACTCCTCCATGCTTTCTTTTTCACAACT |
| GCAGAGTGTTTCTTGGTTGACCTTAGCACTTCTATTGAATGATTCTACTACTTACTGCTGTGGTGAGTT |
| TTGAATTTGGATAGATATTTCCAAATAGATATTACCAGCAGTGTAAAAGTACCTTTTGTGTGTCCTTTCA |
| TGTGGCTATGACATTGTCACTACCAAGGAGCCTCTAAATTTCAGGGGAGGATGGGGAGGCAGGGTCCCTT |
| TGAAGTCCCAAACTTCAGGACAAACACAGGGCCATAAGAAGACCATCACTGTAATATATATCAGAGAATT |
| CATTAAATGGAGATGGTAGTTTACTGGAGTTGGGTTCTGGGGAAGAAATATTTATAGAAATGAATCTCAA |
| GTCCTAAAGTGTTCCTTTATTTTAGGATGACATTTTTTTTAAACCCAACAACATTCAGTTAGCATGGCAG |
| CTAGAAATTTCCCTCTTGGCTTTAATTTTTTCTTTACAGTTTTTGTCAGAACTCAAAAGGTTAAATACAC |
| CACAAACAACTTCTAAACCTTTGAATCAACCTTGAAAAATACACAGATGGATGTATGGCAAGATTGGCTC |
| TGACTGAGAGTGCCTATTCCATGGGTTACATTTCCAGTGCTTTAAAAATACCTGTTCATGTGGTGGTCGA |
| AGTCTGCAAACAGATGGGCGGGTTGGATCCTAACAGACCATCTCCTGCAGTGGGATGTTGGCTGCACCTC |
| CTCTCCTCCAAGATGGCAGCTCAGCCCCATTCCCTTTCCTTCCCACCACCTGTCTTCCTCTAAGTCTGTA |
| CTGTCTTTCTACCCTCATCCTGCCACTACTTCGGTTGTCTTTCTTGCTTTCCTTCTTCTTCTTTTCTCTC |
| CCTCCCCTCTCCCTTCCATGTATCCCAGATTTCTCAACTTTCCCACAAAGAAGCTTGGCGTCTGCAGCTA |
| GTGCCTGCCATTGAGATGGTACCAGGAGCCCACTCCACCCCTCCACATCATTTTGGATGCAACCTGAAGG |
| TCATTAGCCAGTCTGAGGTATTTTCATCCCTAATTTTTCTGTGGATAAGCTCTCCACTTGACAGAAAGGC |
| TTCTCCCAGCCTCCTTTTACTGTTTTATCTGACATCATTTTAGGACCTTGAGTCCCTGAGGGCCTAAGGC |
| ATCCCTGTACTTGGAGGTAGAAAGAGATTCTATCTCCAGGAGAACTCAGAGCAACCTTTTCTGCAAAGA |
| CTCTGGGCCCCTGGTGTCCCACCAAGAAAAGAACCTCTGGATTGTTAAAGGTTATTGGAGTTGCATGGGG |
| AACGAATGAGGTAATCTAGACTCTAGTTCCATCATTCTTCAGTATCGTCTCAGTGTCAGGGAAAGTTATG |
| AGTAGGATTCTGGTCTTAACTCTTCACTTCTGAATTTACTCACCTTTGTGGATTAGACAGAGCCTAGACA |
| TTAGTTTGAGTGTGTGTGTGTGTGTGTGTGTGTGTGTGTGGTTAATATGTACAACTTGTCTGAAC |
| GCAGTAGCTCTGTGGTTTATCTTTTACTGAGAACTGCTTTTTTTCTCTCCCTTTTCTAAGAAAATGCTAG |
| TTTCCTAGACTGAAGTCTTTCTTGTGAGTTTGTCAGCAGAGAGGGGTGTTGTATGAGGGCCTGTCGGTGA |
| TACTAAGATCAAACAGTCACCCAATTTGGGTGACTTTGACACAAATACTGTTGACTGAAATGGTAGTGAG |
| CATGTGATGCTGGCATGTGACATTTGAATATTTGCCAAGAAAAGCACCCAGGACACTGCGACCAGCTGCA |
| AGAGTAAGAGATTTGCCTGTTTTACTGTTTTTACCTGCATTTTTATTTGAGAATCTGAAACCAACCTTTA |
| TAGTTTGGGGCAGGAAAGTAACACAGACAGCCAGCATAAAGCTGTTTACCTGCTTTTGCCTTTCACTGTG |
| TAAAGAATTCAGGTCACTTAGTCTTAATCAAGAGCAGCATAGGAATTAGGGGACATGATCTTAGCAAGTT |
| CGAATTTTCTATATGTTCTTTCACTCCCTGTTCCTGAAATTCCTTTCAAGACTTTTTCATCCTTCTGGTA |
| AAGGTGGTGACCTGCATTTGCTAAAGCTTGGAATTCAGACCTAAGATACCTGGGCCCAGTTGTGGCTTG |
| TTGCTGCTTATCACTATGAGACTCACTCTCTAGCCTTGGTTTTCTAATCTTTAATATGGGACACCCTACT |
| TCATGTGGCCATTGAAAACATCATAACTTCGTTCCCTGCCCTCCTTTCCTTTGAAGAAACTCAGAATTTC |
| CAAAACTGTGAAGTGCAGTATTTTTAGGGCCCACTTAGAATTTTCCTGTAAGAAGAGAGGACAACGAGAA |
| ATGCAGTCTTCTACTGTTATAGCATTTAACCACCACCAACAACCCTTTCCCCCCACCCCTGGAAACTGGT |
| TGCATTCTGATAAAACCTGTGCAGGGACTAGGGAATTGTAGATAGTGTGTCCCCTGATTTTCATGAGTTA |
| AGAGCTTCCCTCTGGCACTTCTGTAGAAAGGCCTTCACAGAATGTAGTTCTACTGTGCTGGCAGTTGTGT |
| CATTAGCCAGGGAGAGTCAGAGATTGCAGCCAAGTTAGAGTAATGCCAAATGTATACCTGTCAGTAACA |
| TCTGTCATGCTCAAGTGCCTATTTAGTCTAAAGAACTAAAATCAGGCTGCACTCCCTAAAATAAAATGTA |

| Sequences |
|---|
| GACAACAAGTGGGTACCCAAACTACAGCATCTGCCAGAGCGAATGTTAGCAAAGGATTAAGGTGACCGCT |
| TGAAATATATAGGTGGCTTAAAACCAGAAATAAAGGATGCCACCCACAGGGACTCCTGTGGGCTCAGACA |
| ACCAGGAGAAGGAAGTTCCCATTGTGGCTCAGTGGTAATGAACCCGACCAGTATCCATGAGGACGTGGGT |
| TCAATCCCTGGCCTCGCTCAGTGGGTCAGGGATCCGGCATTGCCATGAGCTGTGGCGTAGGTCGCAGACG |
| TGGTTCGGATCCTGTGTTACTGTGGCTATGGTGTAGGCCGGCAGCTATAGCTCTAATTTAACCCCTAATC |
| TGGGAACTTCCATATGCAGAGGGTGCAGCCCTAAAAAACAAAAACAAAACAAACAAACAAAAAACGAAAG |
| AAAGAAAGAAAAGAAAAGAAAACCAGGAGAAGAGGGAGGTCTGGGTTGGAAAACAGGATAGCTGCTGTCC |
| AGAGGCAGCCTTTGGAGGCTCTGGAAGGATGTGGGGGAAGTAGGCCACAACATGACATGGACATGGTGAA |
| CACAGAGAAGCCTTTGAGCCAAAGACTTGGTGTTCTGGGTGAGGTGGAGAGAAGTAAAGAGAAGGGCTGG |
| AGATTGGGAACTGGGTCAGAGAACAATCTGGTCACGAGTGAGGACGGAGCGTGTGGGTTACAAGGAGTGA |
| CAGGAGGGCCTGGTCTTCAAAGTCAGGCTAAGCGCAAAGCAACCTGATTTACTCAGTGGAGTCCTGCAGA |
| AATGAATAGAAGAAATCAGCCCCCCGACACCAGTGAATGAATGGTGGGGGAGAAGTGGACTGAGCAAAGC |
| AGAAGGCTGAAGGGCAAGATAAGCTCTTTCTGAGACATATGACTGAACTGAAACCCAGATAAAATATTAT |
| CTTTTAATCCAGGATCTTTCATTAGACATTCAATTTCTTTGTATCTCATTCACAAAAGAGCAATATGCAG |
| GAACTCCTTGACAATGAGAGTGTTACGAACTAAAGAGGTATTAACCAAACGTACTGGGAAAGTATAACAT |
| GGGAATGAAATTTGAAGCCAGTGATAAGATAAAAAAGACTCAATGCTAATATTACATTCACTATTTTGTA |
| AAGGATAAAAGACTATGTTCCCTGGGGCCTCAGTCCACGCTGCGACCCTCCCCCATCACCAAGGGATGAG |
| CCCTGAGGCCTCCAGGTAAGGCCTCCATGATGCACCTTCTTTGCACGCATGTCTGCCCTTCCAGAACCTT |
| CCAGAATCTTCCTCATCTCCCTGTTACTCTGCAAAGTATCCTTAGGGCGCCCAAATCCTGGAAAAGTTTG |
| CATCTAATTCTGCTGCTCCTTTGGATTGCTGTCATCTCTCTTCCCCATGTTTTTAGGCTTCTTACAAGCT |
| GGGTGGGCTGTGTCTCACTCCAGTCCTTCACTCTCTACTCCCCCTGTTCTCCCTCCACCCTTCCCATAGG |
| TCTTCTGCCCCCATTGCTCTTCTAAAACAGCTATCTTCTAAGGGGATCACACATTCATCTTCTGTAGCAG |
| TTGGAACCCAAGATACATCTCTCTTGAAACACTGGACCTTCTTGCTTCTGTTGCACAAGCCTCATTCCTC |
| CTCAGATCTTGCTGACCAGCCCATCTCTGGCCAGCTCCCTGGCTTCTCTTTCTCCTCCTGCTTGGGTACA |
| GCCAGACCTCCATCCAGGCACAGAACTTCTGCTCTGCTCTCTGTTCCATCTCTCAGATCCCACCTCCTCC |
| CTCAACCTTTCTACTTATAGGTAGATGGTTTCAACCTACCTGTCTCCAGACCTGACTGTTCTCCTGTTTC |
| CATCCCATATTCCCAATTCTCTGCTGGTCACATCCACCAGGTGATCCATCACCATTTCAGACTTAGCTCT |
| GCCTCTTCCTTCCCAAAACCATGCCCTCCCCTGACCTTGCCAGTCTCTGGTCCTGGTGGCACCTTGTCCC |
| AGTGCCCTCATCTCAGCCAGATTTGGTTCCATCTTCTCCCTTTTTTCCATACTCAAACTCTCACACCCCA |
| TTTCCTTCATTTCCAACTATGTCTTCATGGTGTTCCTGGATGTAAAATCTATGGATCATCTACTGAATTC |
| TTCCTTGATCTGCATAAGCAGAACAGTTCTAGGTCAAGTGATCATTAGTCAAATTTGAGTCATAGAACCA |
| AGAGTCATGGCCCCTCAGTCAATTCCCAGACCTGAGCCAGTTTACAGACCCATGAGCCCTTGCATGAAGG |
| GGAGGCTGGTTCCTCTTGAGAAAGGACCCTGCTGCACTGCCTGAGATTTCTACCCGTAATCTTTCTCCCA |
| GCTTTTTCCGAAGGGACCCACAGCCTTTTACCAGGGTGATGGGTATATTGGGGAAAAGGAAACAACAGAC |
| CTTTCGAGGAACTCCTGGGCATGGGCTCTGAATTGACACTAATTCCAGGAGGCACTAGACTGTGGGCCAC |
| GGGTCAGAGCAGGGGCTTATGGTGTCAGTGGTCCCCGTGGTTTTAGCCCCACTGCCTTTCCCACAGCACT |
| CTGTGTTTGCTTCTGCTCCCGGGTGCTGCGCTGGCACCAATGGAGCATTTATATTCCCTGGCTCAAATCT |
| TCCACCAGTGCCAGGTTCTCAGGAGGAGGCCAGCCATCTTAGCTGGTGGTGAGAGCTCTCCATAAAGAAG |
| CCCCCTCGCTCCCAGCCTTTGTGGCTGCAGGCCCTCAACCCAGTACTTCCCTGTCCCCACCCCGACTACA |
| GTCCCCAAACATGGCTCACTGTCCTTCTCACTTTGCTCTGACACTCTTCCCCAAACCTTCAATTTCTTGT |
| CACCTCCCTTCTCTAGATCCATGAGGTGCCTGTTTTTAGCCCAAATATACCATGTTCTCTTGTAAAACCT |
| TTTTTCTCCCCTTTAGCTTGTAACAGCCAGGGAAATGAGCAAAATGTGTGGATGGATGAATTCACCAGTG |
| TTGGGGACAGGAGGGGTCCTTCTCTGAGGGGTCGTTAGCGATCTTCATAAACAAAAGGTTGCCTTGTTTA |
| TACCTGTTCTTCAGCGTCAGCATTTCTTAAATCTGCTTCAGGAGAAAGTGAGGGCTTTGTGTTTAAAAAA |
| AAAATCATATGGGAAGCACGGAAATAAGAAATATTCACTTAGGTTAATGCGTGAGTCTGTTCCACAACAG |
| GTGGCCTCTCAACTTGCACAAATAAAACAGAATTGGTCGGTTGAAACCTATCAACAGAGCAGACGGGATA |
| ATGGCCAGGTGGTGGGTCCAGGAGCAGATGGGGAATATTTACTTAGATCTTCAGCACTTCTTGTTAAGAG |
| TCCCTCTAATACAGTACCTTCCCTAGGTTGTGAAATCCACTGCCATGCTCTTTGAATACTAGTGTTTTGT |
| TTGTTTGTTTGTTTTTTAAAGGTAATTCCCATGTCAGTGTCTCTTTTTTTCCAAAGTTGGAGTTAGAGTAA |
| CCAATGTCAGTGGAGTTTGTGCAAACCTGAACATCCCAAGTTTCCTTTCAGATTTTATTAAAAGTTTGC |
| AGATCTCATGAAAGTTAAAAAAACGTAGAAGTTAAATGGAAAATATTATAAATCCCAGGGATTTTTTTTT |
| TTTATGCCGAGTAAGGCAGTGCTACCCTGGGGGTCTGTGGAGACTTTTCCATGGAGGCAGAACCTTTTAG |
| TGATGTGCTCACCCACCCAAACAGTCTGGAACCCTTGGGTCTTCAGGAAAGTATATAATTCTCCATGTAG |
| CATCAGTTCCTGACCATCTTTGAGTTATTCTGCTCCTTTGACAAATGTGACCTGGCTCTGTTGCAGTTTT |
| CTTCCTGCTTCTCTGACCACTGTGTTTCCCCTTCCCTCTACAAAGAGTTAGGAAGCATTCATGTGGCACC |
| TACTGGGGACCAGAGCCACACTCACTTGCGGGGACCTCTACAAAGATGCGCCAAGCCCAGCCCTGCCTCC |
| ACCGCTGCTTCCTGCATCCTGATGCTGAGCTCATGGAGTGGTCCCGAGGCTGGTCCCTACTTCTCCTGCC |
| CTGTGCCTTTTCTCCTTCACAAAGGCTTTTGTTCTCATAGCTTCCATCATAGTCCCAGTCCTACTTTCTC |
| ACTTAAGTCGAGTATTAACATTTCCTTGTTTTCTCCAAAATTCTGTGTGTCCTCAGGACGACCAGCTCCC |
| CATGGGCCCTTCTGCTTCTGTCAGAAGGGGCACAAACTTCCTTTTTTTTCCAGATATGAAATATGGAAAGC |
| ATCCTTCACTATCCTCCCCTTTCTCTTCTGTGCCCAGGAATCTTGTTCAGGCTCCCTCTCACCTGCTCT |
| CCATTCTTTCCTTCTTTGCTGTTCCCACTGCCTCCCCTTCCCCATTCCTGATGACTCATGCACATCCATTG |
| GGGGGCTCTCCACATCAAGCTAGTGTTCCCTCCTTGAAATGCCCTCTTATCAATGTTCCTCTTATTAAG |
| CACCAGAAATACTGTCTTACTCTTTCATATCTCTGACAGCATATAACCCAGCTCCTTGCACATAGGAGGC |
| ACATAACCCACCTTCGTTAATCTCTTGCGGCAAAAGCATAGGTGCTTTGTAGCTTGTTAGCCTTGGTTTT |
| TCCACTTTCTTCACCTCACAGAACCTCCAAAGGGTGATCCCCGTGGCGAGGATTGTGTTAGCTGTGGGGA |
| AAGTGCCACAATGCAGAGAGCGGTGAAATGGATCCACACGTGGGGAGGTGAAATTAGGGAGGAAAATTCA |
| GGAACTGGAATTATTTGATAAAGGAGAGACAGAGATGGTGAGAACTTAAAGACTTCGGGTGCCCTGGCCC |
| TCTGGAGACAATTGTATGTATACACACCAATTCCGCCCATCCTTTAATACCCAGCCCTGGACCAACTGCC |
| TTGTACTTTGCCTGTGGCTCTTCTCTTGTTTCGTGTTAGTGGAGCACAGAGAGCATCAAGGCTGTTGCA |
| AGATGCTTGTGGATGGTGGGCACAGTCCAGGACGCATGGGGTGGGGGGTGGCTCCACATGCCGACGGTAA |
| AGATCTGGGTGGGGAGATGTGGACACAGCCATGGAGGTGACTCAGAGCTCCTCCTTAAAGAAGTTAAGCT |
| TTCAGAGGGTCAGACACAGATAGTGCACCATAACAGAAGGGACAGAGGGGGAAGGCACAGGAGGAAGGTT |
| ACAGGTTCAAAGATAAGTGATGATTTCCAGTGAGAATAAATTGTCAAACCCCAAAGTGGGCTACAGAGAA |
| AGCTGTGGCCTCCTCTTTCCTGGAAATGGTTGAGTCATAACAGACAAGTGCTTCACAGTGGCCTGAGCAC |
| TGACTTCTCTGGAGGTCTGAGGATGGGAGAGAGAACCATTCCTACAGGCTGCATATCTGGGTTGCTGGGT |
| TTGCTTTGGAGTGAGTTAGCTGCTGCTTACTCAACCACAGAAGTGAAATTTGTTACTGATGAGAAATAAT |

-continued

| Sequences |
| --- |
| AAAAGATCTTTCTTTTTCTAGACTTCCTCTATGGGTGTTGTTGTTTTCTTTCTAAATGGGGGATTTGTT |
| TTGCTTTTTTCCTTTCGTGGCATTCAAATTTAGCTTTTGCGTATATCCTGCCCAGTAGTTCAGCGTAAGT |
| TGATGAGAAAAGCCAGGCCAAAATACGATGGATGCTCACCATTTTCCTCGAAGATGGTATGTAGCGTGTC |
| TGTGTGCATGGGAGAAGTCAGGCTGGTGAAGATGTTTGAGAACTCATCAGCATTCACAAACGAGGCCTTT |
| AGTGATGTCAGAATGTTGGCTACATCTTTGACTCACTTACTCTGTGCCCTGCCTGCACGGCACTTGCCAG |
| TTGCAGAAGGAAAAAAAAAATGCATGAGACGTGATCCCTCCTTTTAAGGCACTTAGAATCTATCAGGCAA |
| GATAAACTGTGTTTGCAAATCATCTTATGTATTACGGAGAGGAGGATTATTCTGGTTCAAAGGAATGCCAT |
| TGTGAAGGATGACATCATGGTAGAATTGTAATAGTGAACCTGAAATCCACTTGTTCAATCTTTGTCATTT |
| CTATCTTGGATTAGTTTGATTTTTTTACTTAAAAAATATTATTTCTGAATAAGTAATAGGTTCACATGGT |
| TTATAGCCCAAAACAATTTAGAAACATTTTTATTGATGAATTTTACTCCCCAACTACTCAATTCACTACC |
| CCCTTACTCCTTGCACACAGGTAACTGTGTATGTTAATTTCTTGAGTATATATCCAGTGCCTCTCCCTGC |
| AATATTATATACATATAAATATGCTTTTTTTCTTTTTACAGTCTAACCTGTGACATATGGAAGTTCCCAG |
| GCTAGGGGTCAAATCAGAGCTGTTGCTGCCAGCCTGCACCATAGCCGCAGCAACACCAGATATAAGCCCC |
| ATCTGCAACCTGCACCACAGCTTGTGGCAATGCCAGATACTTAACACATTGAGCGAGGGAGGCCAGGGAT |
| TGAACCCGCATCCTCATGGATACCGTTTGGGCTCTTAACCTGCTGAGTCACAATGGGAACTCCATATATA |
| TACATATATACATAACATTTTCCTTTTTCCTACATAAAAAGCAGGCTTGATCTTCACTTGGTCTGTTAAT |
| TTATCAGTGTATCTTGGAGACCTTAGCATTCAGCACATCTTTTCCTTTCTTCCTGTATAGCATACTACCT |
| TCATAGGGCTTTGCTGTTTGGGGGATATCATGGTGAATCCATTATCTATTGCTTCATGACAAACGGGTC |
| CATAACTTAGTGGCTTATATTAAAACAATGACTTTATTTCTTTACAGTCCTTTGGTGGGTTATTTGGACT |
| GCATTGGGCTGGGCGGTTTTCCTTCTGGTTTTTCATGGATTTACTCCTGTGGATTGGATCATCTGGCAGC |
| TTGGCTGGGCCTTGATGGTCCATATCAGTGGTAGAGGCCATTGCCAGCTGGATTAAGTGTGTACAGGAGA |
| CTGGTCCAGGCTTCTTCCCATGGTCACTGGATTCTAAAAGCAGAGAGGATTATGCCCCACTGTAAGAGGG |
| CTCACTAAGCATCTGCCTGCAGCACAGTTGCTAATGTCCCATCACCCCAGCAGATCACAGGGCCCTGTGC |
| AGCATCAGTATGGCAGGATCTGCCCCAGGGAGTGAACACTGGGAGGAGGCGTTCACTGGAGGTCATTATG |
| TAACCATCTCACCCATATGTCAAATAACCACCCCTATTGATGGGCACCTGGTTATGTCCAACCATTTGGT |
| ATTACCAACAACAATCCGTCAGTAACCTTGTCCATCAGTCCACTCATGTGTGAGCAGGACACGTCACCAG |
| GAGTGTTCCTGTGGCAAAGGGTAAATGCTTTTTAAATCATCTATCTATTCTATTTCTGTGGTGCTATTTC |
| TCCAGTTATTTTAAGCTTGTGCTCATCTGTCATTTTTCCAGGAGCTTTGAAAATGTAAAGAGTTTAAATA |
| GGAAATACACCTAAACTGAATTCATTAGAAACCCATTCCTAAAATAAAAAGGACGAAAGCTAGACTAGAA |
| ATCAAATGATTCTGAATAAAGTAACATGTATTTGAATAAATGTCTATTATTATACAGTGTTTTACGTTTC |
| TATTGTTTACAGTATAGAAACAGTTTGTTTAGAGTGCCTTATTTAATTCTCACAATTCTATGAGTTGAAG |
| GTGTAATTGGCCCCATTGTGTGTGTGTTATACATACATTATATATATACATATATACATATGTACAAC |
| ATGCATATATATTCTGGGTATGAACACACACTTTATATATATATAAATATATACATATATATTTATGTAT |
| ATATGTATATATGTATATATACATATACATTTATATATTTATGTATATGTACATAAATATATAAATATAT |
| ATATATAAATATATATATATATACACATGTGTGACATACATATATACTTGTATTTTTTCTCTTTTAA |
| AACTTAGAGAAGTTACATGAATTGCTCGAACTAGCAGGTTATAGCCAGGGTCTATATCCAGCCTTGTGAC |
| AGTAAACTTGACTTCTTCCCCTTAACTGCATCTCCTTTGTAAGGACTTGTATCATGTCTTAGCTTAGCCT |
| CAAATGACTTTCATTTGCTCCAGTTGCCACATGAATACATCACAATCATATGAGATGTCGTTTCCGGAGG |
| TTCTTTTTTAAAAATTAGAAATATTTCATTTCTAAGTTCTAAATACTTGGGAATCATCCCTAAAGTTTTC |
| TCTTGTTTTTCACATGACATTGCTGATAGCTCCATATCCTGATCTGAGTCATTAGTAAATCTTGAAGGAG |
| GAATGCTTTTTAAGCCCATGTGCTTGCTTTCAGTCTTCAGGAAAGAGGAGGGAGTTGTTTTTAAATAAAA |
| CCTTGTCTGGGCCTCCAGCAGCGGACATGGAAAGTAGACTGTTGTGTTTGTTTTTTTTGTTTTGTTTT |
| TTTTTTTTTTTTCATTCACACTCAGATGTTTTCATAGGGGCTTGGTCACGGCAAAGTGGGCCCCACATAC |
| AAACCACCCACTTCCCTGAAGCTTGATTGATGAGCAAAGCTGTTCTGCCTAAGGGCAGCCTGATAGCCTG |
| AGCCTGGATGATGACAGGTCCGACAGGCACAGATTTGAATCCAGGTCTCTTGCCCCCTGACTGCAGGCTG |
| AGGGCCAGGACACTGGTTCTTGAGGCAGGAGAGAGGAAGAAGGATCCACTTTGGGGAACAGGGCAAGCTG |
| CATGGATTGGGGGTCACCCCCCTTTCTAGAATCCTTGAAAACGTGGCAGCTCAGGCCAAGGTCTTCTTG |
| CTAAGAGAGCTCCCACTGGTGCTGCGTGCCGTGAAAACCAGGCTGCAGAAGAACTGTGACATGCAGGTGA |
| GTGGAAGGATGCTTGGCCAAGCCTGTGCAAATTGGAGGGGGTCCCATCTGACCCTCTAAGAGAG |
| GGTCATACATGTCAAGAGAGATAGAAATTTGGTGCCGAGTCAATGGAAACTATGATGGAAGTTTGGAAAT |
| GCAACCGAGCAGGGACACTGTAAACAGGATGAGTTGGGACCATGTCTTTTCACATTTGCCTCCTTGGCAT |
| ATCCAGCGGAGCGTCATTTATAGAGTAGACTCTAGATAAGTACACAGCCCCGAAATGCTAAGCTTTGACG |
| TAACCTTGGAAACCATCATGCCCAGGCTCATTTTAGAGAAAAGTAAACCGAAGCCCAGGAAGGTTCGGTG |
| AAGGGCCACGGGAGGTGGGGGTGGGGTGATTGCCTGGTAGAGAGCCTGGGCTTCTAAATCTTAGTAAAG |
| TTAGTTGTCCATGGATTGTGCTGCCAGTGTTCTAATACAGGTTAAGAGAAGGAGTGAATAAATTAATTTC |
| CTTTTTAAAGAAGCCTGGTTGAAAGTTACTCATTCACTGAAGTCACAGAGAATGACCCACTTAATTTATT |
| TAAACATCTGCTAACCTGAGCGATCACTCTAGCAAGTACATCCTGTTGGGGGTGGTGGGGAACAGGGGT |
| ATGTGAGAAAGAATTCGTTAGTGTCTTTTGAAAGACTTTCAGGAATCTGGGTTTCAAAAACATTTTGCAT |
| ATCTTACAGAAAGCCTTACATGTCAGTGTTGGATGAAAAAAGTGGATTTTCTAACAGTGATTTGTTAC |
| AAGTTCAAGGCATGGATAGGCTGGTGGGAAAAATGAACCCGAGGTTAAGCATAGTTTTGGTGCACTGTA |
| GTGAATGGGATATCAGGTAGCAGGACGAGCAGACATCTTTAAGGAGGAGGCCCGGATCTTGTTCTTGGTT |
| CCTCTACAGGGCAGCAGGCTCACTGCCCATGTCACGCTGAAGGTGCATGACTTGTTCCAAACCCCCTGCT |
| TGATGGGACTGAGGGCTCACTGGATTCAGACATTCAGCCTTAAAGCCACCCTTTCCTTCAGAGCTTAATT |
| TTTCTTCCATCACATGGTCCACTGTCAGTTTTCTATCATCTTTGCTCTTGGCGGTCTGGCTGCCTGGGA |
| TGGCAGGGAGAAACTCTCCTGGTTGCCTCTACACATGCATCTGCTAGAATCTGTTGTCATGAATAAATGT |
| TGACATCTGACAAAAGAGCGTCTAGGGAAAGCTTCCCTTCCTCTGCAAAGTGTAAGGGGTAAGTCATTATC |
| TCCCTTTTTTGGATATAAATCAGGTATCATTCTGCCACCCACTGAGAACATTTTAGAAGCCCATTTATAA |
| TATCTACCTCACTGCCTCATGTTTGGTTTCCCGTTTCATAAAGAAAAACCTGCAAATAACCAAAAGTAGG |
| GATTCCAGTGAAATGTAGGTTCTATTTCACTATATTTGGTGTAGGGATTCCAGTGAAATGTAGGTTCTAT |
| TTCACTATATTTGGTGTGGGAGGCAGTGTAACTCTAACTCTAAGAATACCGGTTGTGGTATCTATCTACA |
| TTCTAAGAATTTATGGAGGCGAGGTTTGTACCGAATTAAATCACCCCGTCGTATCTACGAGGCTTCCTGT |
| AGAACGAAGGTAAAAATGAACCCAAAGAAACAAAACAGGAATGTGTCTCAAAACAGAGACACACACTTCT |
| CCAGCAGTAAAGATTTTGAAATGGTCCTTGAAAATTTTATCGCAGACCTGCTCACTAGAAAAAAATGCCT |
| TGGTTGTTGTTATTGTTGTTTGTTGTTATTGTTTTGGTTTTGGTCTTACCACCTGTATTTACCCCATT |
| TGTGGTTGCAAACGTTGAAACTTTCTTGATAAAAGGGGAGGGAAATAAGATGCTGCTGCCCACAGCAC |
| GGGAGAGGTGGGGCCAGCCGGCTAGGAAGTATGCATGTCTGTGTATCTCTGTGTGTCTTTGTGTCCAT |
| ATGTCTGTCTGTGTATGTCGCTGTGTGTCTGTGTGTATTCATGTGTCTCTCTGTATTTGTGTGTTTGTGT |

-continued

Sequences

```
CTGTGTATGTCTGCGTATGTTTGTGTGTCTGCGTATCTGTGGGTCTCTGTGTATAGGTCTGTGCGTCTAT
GTGTCTGTATGCATTTGTGTGTCATGTGTCTGACTGTGTGTCTGTGTGTGTTTGTATGTCCATGTGTCTG
TCTGTCTGTGTCTGGGTGTGTTTGTATGCCCATGTGTCTGTGTGTCTCTATGTATTTGTGTGTCTGTG
TGTGTGTTCATGTGTCTGTGTGTGTTTATATATCTGTTTGTGTGTCTCTGTGTTTATTTGTGTGTTTGCA
TGTCTATCTGTGTATGTCTGTATATGCTTGTCCATCTGTGTGTCTGTGCTTGTGTGTGTTTGTGAGTCTG
TGGGCTTGACTATGTATCTATGTGTGTGCCTGTGTGTGTCTGTGTGTGTCAGTGTGTCTGTGTGTCTCTC
TTGTGTCTGGGTGTGTTTGTGTGTGTATCTGTCTGTCCCTATGTGTTTGTGTGCCCATGTGTCTGACTGT
CTGTCTGTTGTGTCTGTGTGGGTTGGTGTGGATGCAGGTACATAGCATTTTCAGGTTAAATCGTCTTCCT
TCAGCATGACCATTTTCCTGAACCTGAAATTACTTTGTCGTGAAAGCAAAGACAGTGACTTTCTTATAAA
ATAAGGACCAAATAACTTGGCAAGCTCAAATAAAATCCACCCTTCAACCCAATATTAAAGAACGTAGAAA
ATCCCACTTGACACTGAGGAAGACAGACCAGTTTGGTTTGAGTCTCTTACTTGTCTGTATTTCTTTTCAC
CCCCAGCCCCCATTTGCCCATGAAAAATGCTGTCTCACCGACTACACATCCCACCTCTCCATATCTGCCT
GGTAACGAATGGCTTCCATTTGAACTTAAACTCTGTGGTGGTGATTGGAGAATGATGAGGATGAGATCCT
GAACATGACATTATCTTAGGAAAGCTTTCCTCCCTGCCTCCTGCCTCTCCCTCCATTGCTGTTTCTGTCA
CTACCCCCGCTTCCCAGATGTGAGCTTGCAAAAGCTCAACCCTGGCAGTAACTGTCGCTGCCCCCACCCC
CAGGCAACACCCCAACCCCTGGGAGCTTCACAGAAAGTGCAGCAATAGTTTGGCTTCCAAATGCATCGT
GCCAGATTCTAGCAGGACACATTGCAGTAGGAGACGGGAACACAGGAGCCCCCAGGTCATCAGTTCCCAC
TGCATGACGGAAACAGAGCTAGGGGCTTGCCTTGCACTACTTGAGTCCCAAAACCCATAGGCAGGTAAGC
GGTCTCCTCATTTTCAGAGGAGGAAACCGAAGTTCAGAGAAAGTAAATGATCTGTGGCTGATGGCACCAC
TCCGAAGGGACAGCCTGTGGCTTCAGCTCAGGGCAAATGCTGATGGTTATGCTTCGGGCACTGCAGCATC
CTCAAAAGAAGCCAAGCTGTTAGGAACGCACTCAAATCGATTTTCATCCACATGAAATGGCAGGCGTGTG
ATGCCAAACCATAACATTCTTACTGGCTTCAGGAAGATGTTATTTTTTCTCACCTGTGTTGCTATAATC
ATCCTATTCTCTGTTCTAAGAAATCAAATCTACAAAGAAAACATATTTGAAGAATTTTTTTGTCACTT
CTTGTTGTGAGTTGAAGTCTGACAGATGGAGGTTAGATGCTAAAACATTGGGATTTATAAAAATGATTGT
GTATGTATTAATAATTAAGAGAAAAGTTGGTTGGAGTACAGAATTGAGAAATCCGAGGAGTTCTTGTGA
TAGCTCAGCGGTAATGAACCCAACTAGTATCCATGAGGATGTGGGTTCGATCCCTGGCCTTGCCTGGTGG
GTTAAGGATCTGGTGTTGCCTTGAGTTCTGGTATAGGTCGCAGTTGCAGCTCAGCTCCTGTGTTACTGTG
GCTCTGGCGTAGGCTGGCAGCTACAGCTCTGATTTGACCTGTAGCCTGGAAACTTCCATATCTCCAAAAA
GACCCCAAAAGAAAGAAAGAGAGAGAAAGGGAGGGAGGTAGAGGGAGGGAGGGAGGGAGGAAGGAAGG
AAGGAAGGAAGGAAGGAAGGAAGGAAGGAAGGAAGGAAGGAAGGGAAGGAAAAAGTAAAATCTGAGAAA
TAAAGCAAATCCAAGCTGAGGGGAATATGTAGCTATAATATGATGCTTCCAGGTGTAGGAATCTTCAGGT
TTGTCTCTGCCCCAGTCTTCTGGAAAGGCATCTGTATTTCACCTCCTGTGATAAAGGCCCATGTGTCTTT
CTTGCTGCCTGAGTTAACTAAGCATATTAACTGCACTAAATGCTCAGCTCTCCTTAATTTTCCTTAGGCT
TGGTTGGCTTTGATCTTTACATTTCAAGGCCCCAAAAGACCAGATAGAGGGAGAAATAATCACATTACAT
CTCCTCCTCCAGTATGGTCGCTTCAACCCCAAAGGATGCCTTTCAATCAGGAATAAGGGTTTAGGAACCA
AGTGACAAAGTTACACAACTGAACTTTCCCCCCGCCTCTTTTACTAATACTTAATTATTATTGATTGTT
TTCTTGGCTAAAACCCATTTCAAAACCTGCACAAATGAACTTTTTCCGTACCCAAACCTTTGAAAGGATA
TATTTGAAGTATTTTGACGCCTAAGAGAATAGCTTCTAAACAAGTTATGCATTGATTTCCTCTTACCCTG
AATTATTTTCTCGCCTGATTTTCCTGAGGTTGTTCCTGAAACATTCTTTGTGGTTCACTGAACACAAAAA
ACAAACCATGTACCAGGTTTGGTGGGAGGTGGGGGTGGTTTCTAGGGATATGGGAAACACGGCATTTGTT
TTCATGGAGCATAAGTTTCGTGGAGGAAATAAGGCACTTTGACAAATAGCCATAAGGTAAACTAGAAAAT
TGTCAAGTGCTGTAATTTTAAAGCTGATTATTACATACCTAAAAGCTGGTCAAATTACAGTTTTATTGAA
TGCTAACGAATTATTACTCCCCTCCTGCACAGAATTTTTCAAACTCTTTACTTTCTCTGGCTTATAATTA
CGGTAACCACATTTTCCATACCCCAAATTAAGATACACGGTCTGACAAAGGATTCTTGTACCACTTCTAG
GTGTGAGACCCACCCATAGTGAGGTTTTTTCTTTTTAAAAGCAGGTTTTTTTAGGCCAGCTCTATAAAAAA
ATAGAGGTTTGTTAAATAGGTGTGGTTTTAGACTTTTCATTAAAAACCTACCATGCAAACAGTATTTTAT
TTTGCATCTGAATCAACATGTTATATCCTAAAGCAGGATTTTATAGCCTAAGGGTATGTGTTCGCCTATT
CATAAAAACATACTGCTGGATAGAGTAATAATACCTGCCATTATCCAGGTGTAATAAAAAGGTCCCAAGG
GTTCTGCTCAGGGTCTTTAATTTTCCTTTTGAAGATAAAGCTCCTTATTTCACTTTTCAAGGTTCAATGTT
TTTGAACCTTGCAAATGATTACCATTGAGGCATGCCAGATGTGAGTAATTGGGAGCAGTAGTTCTTGAAA
AGAGGGTGAAGGAGTGACTTTTTCTTTCTTATGGTCTCTCCCTATTATCATCTGTGGTTTCTATACATGT
AATTTTTCACACAGCAAGGCCATGTGGATGGGTAGTGGCCAGCCTGCCGTAGTCTAGACATGGGACTTTT
GAACTTTCAAAGGTAAGGTAGGCCTGCGTTGATAATTTAAACATGATGAAACCAAGGCCTGCTTGACCAA
ATATTAAATGTCTTACCCAAAGCCACATAGCCTGTCAGGGCAGAGCCAACTCCTAATCCCCAGCTCTCTC
TGACCAAGGTAGGTTTCTATTCCCTGCCATGATGTTTTCTTCTATTCTAAACTCACTTTGGTCCATTCCC
AACTAGTCTGATATGAGGGCAGCCCTAGTCCTGGAGAGGTAATGACAGGAACGATGGCCTTGCTGCGGCC
CGGACTCCTCAGGCTCACCCTCAGTTGGCTGGAAGTTGAGTTCAAGGCAAGTCATACATGGTGCTTCCCA
CTTTCCTGGGGATCATTGACCTGCTGACCCAGGAGCCCTTGGGACTAGACTTGTCCCATAATGCTTGACT
TGAAGTTGAAGTACCAATTACTGCTTTTTTCAATAGATGATTTTGATCACTTGTTTTGTAAGAGGGCTGC
ATTTATAAGTTGATGATCTGAGTGCACTTTTAGAATACATCCTTCCATCAAACACATATCAGACAATTAA
GCTATTAAGATAAATGACCTTAAAAAACAACCTCATGTCGCTATAACTTCCATTCATTCATTCGCCCAG
TGACCATTGAGCACCTACCATAAGGCAGGCCTTTTTCTGGGTGCTGAGGATACAGCTGTGAACAGAGAAA
AATTCCAGCCCTTTTGCTTCTATGCCATTGGATGGTGTTAATAAATTAAAACCCTTAGCTTGCTAAGAAT
GTGGATTACCATAGAAGCTGAATGGTAAAAGAAAAGTGATCTGACATTTATTGGGTATCTGCAACTTTGC
CATGTGCTGTGTTAGGTACTTTATCTCATATAATCATCATAACAACCCTATGAAAGATGGATCTGATTAT
CTTTATTTTTGCAGATGAGGAACCATGGTTTAGGAATGTAATCTATCTTACTTAAGGTCAGGCTATAAG
GAAATAAATCTACATCAGTCTTTTCACTAACATGTTATATGTGGTCATATCAGTTTAGAACCATGTATGT
GATGTATGGACACCAGACTGTTGTGGAAAAATAAGTTGAAAAACCTTAGGGCACATTTTACTGATATTA
ATAATACATAGTAATGTCATTTCATTGGACTCGCTTGAAATAGCTGGAATTTAGTTATTCAGTCCATATT
CCCCTTTTTCCCATTTTTAACTATGTCTAGATACTCATGTCGCAACAGAAGAAAGGGTGGGGAAAAAC
TGTAACTGCAATGTATACATCTAAGGATGACCTGACCCCCTTGCTGTACAGTGGGAAAATAAAAAAAAA
ATAAAATAAAAAAAAATAAGAAAATTGACAGAACATTGCAAACCAGATATAATGGAAAAATAAAAATCA
TTTAACACAAAACAAAACAAAAAAAATAAAAAATAAATTTCTGAATAGCAATAATCACTGTAGTACATCT
CCTTTCATAACATGCATCTTCCCTAGAACACCTCACCCTAGATTAGCTGTTCAATGACCACAATGACATG
TGCTTCTCAGATAACACATGACCTTGCATTTGGCTCAGAACTTAGTGGTTGGCTCTGCTAAAAATAAGTC
TTTAATGGTTTATTAAGACATTCATCATGGGGTGCTGGTATTTGGGAGTTTTCTTCTTCGTATCATGAAA
CATGCCCATGTATAGCTCTAGGATTTATTAACCTTGTTTCTTTGATGAAACGCCTTAAGGATTTCAGAGA
```

| Sequences |
| --- |
| TCCTTATTTTATTCAGTGACCCTGTATTTTTTTGCCCCCCAAAGCAGTTAACACAATTATGGGATCTGCT |
| AGTGCTCGGGGCCCAAACCCTTCAGTGTGTCTATTTCTGGGGAGGAGCGAGAGGCTGGATTAAGGCTGGG |
| AGTTGGGGCAGCGTCAAGGGGAGGGTCTTTTGCTGACTTTGGTCTTGACCAAACAAGGGTTGATGAAACA |
| GCATGTGCTATGGCCGTGGTGTCACAGGCTGATGTCATCCCAAGAACCCAGCTGTGCTCAGCACCTCGCT |
| TGATGTGGGGGAGGGGTGTCAGGAGACAGGTGCACTTCAGCTGCCCCTTCTCCCCAGTGTCTCTGCTCA |
| TCTCTCTCATCTCTAGTTTGGGGTCTTTGCAAACGAGTTGTGTTTATGTTCATCTTATCACCCCCCAC |
| TGCTTCCTGTCACTCTAGGGTACTCCCCAGGCTCGTCGTCTTTCTGGTTTAACAAGTACGTCACTGCCTG |
| ACCCCTTCACAGCTCCTCAAGCTTTCATGAGCTGCATGGGCTGATCCTGATCCTGTAACACAACAAGCTT |
| GCCTCTCAGGGCCTTTTGCCATCTGTCACCTCTGCCTGGATTGTAGTCCTTCTCATTGTCTTGGGACTGC |
| TCCTTGTGGCCTTTCAAATCCCTGTTTAAATCTCACTTCCTCTGAGAAGCGCCCCTGACCACTGGGTCC |
| TTCTGTCTCCTCTCACCCTCCTTTCATCCGTGGATGTTACAGTCATTGCTTGGCATGTTTATTCTTTCAG |
| CTCCATGAAAACAGGGACCACGCCTACCTTATTCTTTATAACACCCTCTGCACTCAGGGCATCAGCACGT |
| CGTGGTTGATTGAACAGCTGTCAAAGGAAGGAAGGGGGCACTCAAACTGTAGGTGGTTTCCATATCACAA |
| GCTATATTTTAGGGTATTTTTTAAATAATGCAAAAGGAATAAAAACCAGGCCCTTTAAGAAATATTTAAT |
| ATTTCACATGTACTTCAACGTTTAGCGACTTCTGATTGGTCAGAGATTAATCAGTCACATACAGCACTCT |
| GTCCTCAGGGGATCCAAGTGCACTGCTCTTTTAAGCTTTGCAAGCAAACTCTCCTAAAACCTTACTCGCT |
| GGCCCTGATTTCAGAATCTCCACTTAATGCATCAGGAACCCTCAGGGCTTATCCTGGCCTTCAGTGCTGG |
| TTTCACTTCTTCAGTAGCAGCTGCTCTGCACGGATGCCCACAGTGAGTGATTTCCCCCAAACCTGCCTCA |
| GATGCTTAAATGGAGTTTGATGGATTTCACACACACACAAAGCACTTTTTCATTTGAGTAGCTTAGTGAC |
| ACTGTTGAATACAAATGATCTGTTCCTGAATATCCTGGAACCTCATGAAAATTTTTCTAGCTAGAAACTG |
| GATTCAGTCAAAGATAGGCCTGTCATAGACTGACCAAGGGGATTCATAGTTACTAAAAGAGAGATTCTTT |
| TTGGGGGTGGTGGGGGCTCATGGCGTTTGGAAGTTCCTGGGTCAGGAATCGAACCTGTGCCATAACAGCA |
| ACCTGAGCCACCACAGTGACAACACCGGATCCTTGATCTGCTGAACCACAAGAGAAGAGATTCTTAAAGT |
| GGTTTCATTTGCTGGGGCAGCCCAATGGTTTCTAGAGTCCAGAAACCATCTCTAGGGCCTTGGCCTTGAG |
| CAAGGGTGCTGGGTGAAGGCCTCCTTCCTCTGTGGAGGGAAGGGACCGTGCAGGGCTTGTGATCCTGCTT |
| TCTGAAGGTGAGACATGGGCTCTGGTGATCAGAGACTTCACTTCCCCAGGACTGTTGGTATCTGACTTTT |
| AAGGCTAATGGAACATGTCTTTGTGCTTGAAGTTGTAACCTTATTAATTTGGGGAGGAAATGTAGGTTGT |
| GTTTCAAAAACCTGACTTTTGAAAAACTTTTAGAAAATGTAAAAAATTACAGAGGGGTGGATTTCCTGCT |
| GTGGCTCAGCGGTAATGAACCTGACTAGTATCCGTGAGGACACACGTTTGATCCCTGGACCCGCTCTGTG |
| GGTTAAGGATCTGGCGTTGTTGTGAGCTGTGGTGTAGGTCACAGATGTGGCTTGATCTGGCATTGCTGT |
| GGCTGTCGTGTAGGCTGCCAGCTACAGCACAGATTCAACCCCTAGCCTGGGAACTTCCATGTGCCGAGGG |
| TGTGGCCCTGAAAAAAGAAAATTACTGAGGGGCTATCTTCATATTAGCAAATCACAGAGAGTATATACTG |
| TGGCATAAAATTACGTAGTCAAGCTTTGCATTCCAAACCAACTACTTAATTGATCTGATTTCAACAGTGT |
| ACTGTTAACTGGGGGACATTTATCAAGCATGGATTTAACAGGGTTACTTTGGTTTCTGACTAGGGGGAGT |
| GATGGGAAACAGCTCTTTTTCAAATTTTTTATCCTGGGAGGTGGGCATCTATTCTTTTGTTCAATTTGAC |
| AGTTGGAGTGAAGAACCAGAATTTTTTTTTTTTTTTTCCTTTTAGGGCTGCACCCCCAGCATTTGGAAG |
| TTCTCAGGCTAGGGGTCAAATCAGAGCTACGTACCGGCCTACACCACAGCCACAGCAACTTCCGGATCC |
| GAGCTGTATTTGCGACCTATACCACAGCTCAGGGCAGTGCCAGATCCTTAACCCATTGAGCAAGGCCGAG |
| GATCAAACCTGCATCCTCATGGATCCTAGTTGGGTTCATTAACCACTGAGCTACGAAGGGAACTCCGAAG |
| AACCAAAACTTTTGATGATGAGATCAGGGGTGAGTAATATGGTAAATTTCAGTTGAAGTACAGTGAATGT |
| TCCAGTTAGCTAGAAGAGTGAGGTGTCCTGGTTAATTCAACCCTCTTTTAACCTAGACTACTTCTCTATG |
| ACTAATTTTTATAGACTTCAATACAAAAAAGATACCTAACACCAAAATGATACATATGTATGTCTTTTAA |
| TGATATGGAAGATATTTGAGGGTTTCCCCAAGCCCCAGGGTCATCGAGATATCAATTATCTCGGAAAAGT |
| CCTTTGGTAGGGCTTTGGGGCTGATAGAAGAATGGTCTGTCACTGCAGGTTGGAACTAGCACTTGTGTTT |
| CCTTGGGGGAGAGACGAGGTGGGGGTAAGTGGGGAGCTTTGATATCTTATTTCTGTTGGCCAGAGGTGAA |
| GGACAGTTCTTATTTTCCCACGTCTCATCAGGCAATCTGTGAAGATTTTATTGGGCTTATAAATACTCAC |
| AAATACACAGACCCTAAAGCGATAATGTATGTAAAAGTATTTAGTGCCAAGTCTAACACACAGAGAAAAC |
| TTCAGTCAAATGCAAGGTAATTTGAACAGGTTTAACTGTGTTTCCTTTGGTTTATGGTTGCTTTTTTCTT |
| TGGGGAGTCAGAGAGCTCTTCATACACCTCCTTCTTAGCTGGAGGAACTTTATTTGCCTCAGTTAGGACC |
| GCCAACATTGTTTACTTTTTTAAAATGAAGCATCTGCTGATGAGAACTGCAAGGAACTACCACAAATTTA |
| AGAGTAAATAAGTCAGTTACCATTATGACTTCAGGTTGTACCTTATCTCAGGGAACAAGTCTAGAAAGA |
| GAGAGAATTAGGAGAAGCAAGTATAAAAAAGTCTTTTTTTTTTCATACTCTTAAAGGAAGGGTAATTGGA |
| CCTTAACTTTGAAAATACTAAGGTTACGTACTCTTTGACTCAGCAATTTCACTTCCAGGAGGTTTTCTA |
| CATACACGGAAGGACAGCCACTGTGGCGTTATTTGTTTTTTGCAGTAAAAGCCAAAAAATGAACAAACTG |
| GGTGGGGGGGAGAATATCTGTGTAGGGGACTGGATAAATGATAGTAAATTTTTTTTTCATGAACTAAAATA |
| CAGCTGTTGGAAGTTCCTGTTGTGGCATAGTGGGAACAAATCCAACTGATATCCATGAGTTTGCAGGTTC |
| GGTCCCTGGCCTCGCTCAGTGGGTCAGGGATCCAGAGTTGCAGTGAGCTGTGGCGTAGGTCACAGATGTG |
| GCTCAGATCTGGCATTGCTGTGGCTGTGCACAGGTCGGCAGCTGGTCTTGACCCCTAACCTGGGAACTC |
| CCATATACAGTGGCCCTAAAAAGCAAACAAAACAAAACAAAACAAACAAAAAAACCACACACACACACA |
| CACACACACACACACACAAAACACAGCTGTTAAAAACGTGATAGATATATGAAGTCACATAGAAAA |
| ATGTTCAGTTATTTTCGAGTGGAAAAGTTGAAGTCTATGGAGCATATGATTCTCATAGATGAGAAAAAAAT |
| TAGATACATGAGCCCTGGTGACTCAGTGGGTTAAGGGTCTGGCATCGTCACTGCTGAGGTGTGGGTTCAT |
| TCAATCTACAACCCAGGAACTTCCACATGCCGTGGATGTAGCCCCCAAAAGCAGATAAATGTGTGTGT |
| GTGTCTGTGTGTGTGTGTAGACATAACATTTTCTGGAAGGATATACAATATATGTTTTGTTAAT |
| ACAGTATAATTATAATTATGGGTATTATGAATTTAAATTCATAATTAGGACAAATGAATACAAATTAAGA |
| TCAGTTGATATACACATATTAATTGCTTATAGCAAAGTGGGTATTATTAAATTACTTAAAAGTTTGCTCT |
| CATGTTTGTTAAGTATCTTCTAGCTTGCATTCTAATTTTACTTATTCAGTCTTGTATGATTATCACATCTA |
| CAGTTAAACTTCAGTCAAGCTTGGAGTCATTCCTAATTTTCACATTGATGTTTTATCGATTCTCTGACA |
| GTGTAGCAGATAGTGGTGATCACACTGGTCACGACTTACTGAAGCCCCACCTGTGTGCTAAACTCTTGTG |
| CTTGTATTTTCTCTAAACCTCACAAAATCTGGAAAGATGATGTGGAAATGGAGGCTGTACAAACTTAAGT |
| AACTCGTCAGGAAGCTGAAGCCAGCAAGTTTGGAAGCTAGCACTCAAACTGGGTCGAACTCCAAAGACCA |
| TGCTCTTTCCATATGTCCTTCTGCAGGAGATATGGTGCTGGTGAATTAATTTCTCAGAGACTCTATTTTG |
| CTGTTGAAACAGATGATTTTGAAAAAAAAAAAGCTGTAACAGCAAACACGCTCTAATTGTTTGCTCTT |
| CTTCTTGCTTTCTAGCACATTCCATTCACCATTGTTATTAACTATTTATTCTGCGCCTCACATTTGTCTG |
| AACTTTGAACATATGCTTACAAAGCTGATGGAAACTTCCCAAGCCCATTTGATTCTGCTGCTATTTCCAG |
| AGTGTGAACCAACTCGATGGTAGTGAGGCCAAGTGCAGCGTGCCATCTGAGAACGACTTCAGCCTTTGGG |
| GTTGGACCTGATTCAGATGAGAATGCCATACCGTTGTTTATTTTCTTGAGATAAAGAATAAAGAAAAATA |

| Sequences |
| --- |
| CGAGAGCAAAGTCTGCTCTTGAAAACATTCAAGTAATGTAATTTTTATTAGTTGAACTAATGTTAGGCTT |
| GGCCTGGTTTTGCTTCTAGAGATTTCTAGTTCCATAGGGTACACCCAGGGTGGCCACGTAGAAGCAACAG |
| TACCACTCACAGGACAGCCCTTCCAAGTCCCTACCTCCCTTCTTGCTTTGCTGCCAACCTTCATCCGTTC |
| TTTCCTTCAACTCTTTCCTAAGACCTGGTCTTTATCTGAAGGTGATCCTGATGTTTTCAACCCAGTAAGG |
| TGAGTGAGATGGACATAGAGGAATGTGTCCACAGAATAGGCATCTGACCCAGCTTTAGGAAAGGCTTTTT |
| AGAGGAAATGGTAATGATTGTGAGTCCTGAAAGAGAAATAACAGAGGCACCCAGTTATCTAGGAAGAGAG |
| AGAAGAAACGCCAGAGGTTCTCCCGGAGAACTTGGTGTCTCTGTCCAGCTGTGTCTCCAAGTGTCTGACC |
| ATCTCTCTTTTTTTTTTTACTCAAATGAATTTATCACATCTGCAGTTGTATAATGATAATCACAATCC |
| AATTTCACAGGATTTCCATCCCACAGCCCAAGCACTTCCCCCCACCCCCAAACTGTCTCCTTCGGAGAC |
| CATAAGTTTTTCAATGTCTGTGAGTCAGCATCTGTTCTGCAAAGAAGTTCAGTCTGTCCTTTTTCAGAT |
| TCCACATGTCAGTGAAAGCATTTGATGTTGGTGTCTCATTGTATGGCTGACTTCACTTAGCATGATAATT |
| TCTAGGTCCATCCATGTTGCTAAAAATGCCAGTATTTCGTTCTTTTTAAAGGTTGAGTGATATTCCATTG |
| TGTCTATGTACCACATCTTCTTGATCCACTCCTGACCATCTCTTTTGAATGAGGATATTGACTATGAATC |
| AGTCCCTTGACTTTGTTAAAGTTCTTCAAATCAGTAGACTAGAGTACGTATCAGTTGACTAGAATACGAA |
| AACATTCCTGAGGGAGCTCCTGTTGTGGCTCAGCGOTAACGAACCCAACTAGTATCCACAAGGACGTGGT |
| TTTGATCTCTGGCCCTGTTCAGTGGGTTAAGCATCTGGCATTGCTGTGGCTGTATCGAAGGTTGGCAGCT |
| GCAGCTCTGATTTGACCCCTAGCCTGGGAACTTCCATATGCCACATTGTGGCCCTAAAAAGATGAAAACA |
| ATTCCTGGAATAAATGACTTTTTTTTCCCCTAAATACTCCTCCCACATCATTATTGATACCATGGGTACT |
| TATGACGCTTACATCTCCCATATCTGTCCCATCTTCCTAAATTCACATTGGCAGGTGATGTACCTGGTCA |
| AGGTGAAAACTTTGAGGACTCATGTAGACTGAAACGATAACTGCCATTTCTGCAAAAGGGCCTGTTGGTA |
| AAATATTCTTTTTGCAAACCCTGGGAAATGCATAGGTCTGGAGGTTCTGTTTTCAGTAACAAAGATGGAT |
| ACTCACAGGAGGGGAGGACAGAAGAAAACAGAATGCCCCAGCCTTAGGCTCGGCGTGTGGACTGATGGAA |
| ACATCAAATGACAACTTTCCCTTCATTTCTCTTCCTGTATCCAGTACTAAGGCAGGCATCTAAATCTTGA |
| GTTGTATTAACGCCTGACAATGTGTAAACATAGTTTCCCAGTTTATATACATCATAGTTTGGTCTCTCAT |
| CTACCCTTCAACTAGTCAAGGAAGCCCTTCCTTGGAGTTCTTTTCCTTATTCTATTTCAACACCCAAATT |
| TGTTTTTTGCCCATGCATATGAAAACTAAAAAAGTGAAGAGCAAATTTGAAAGTGTGTTTCAATGCACGA |
| ATCAACCTGACAAAAGGAGAATACACGTACACACACACACACACACCCATATATGCATATGTTATATTGG |
| ACTTGAGAAAGCCAGCAGAGAAAAAAAGGCAATTGCATTACAAGGTTTTTTTCTTTTTACAGCCGCTCCT |
| GTGGCATATGGAAGTTCCCAGACTAGGGGTCGAATTGCAGCTGCAAGTGCAGGCCTACACCACAGCCAC |
| AGCAACGCCAGATATGAGCCATGTCTGCAACCCACACTGCAGCTTCTTGCAATTCTGGATCCTTAACCCA |
| CTGAGCAAGGCCTGGGATCAAACATACCTCCTCACTGACACTATGTTGGGTTCTTAACCCGCTGAGCCAC |
| GACAAGAACTCCTGTATTACAGATCTATTCTGGTTCCAGGACAGCCATACATGGAATTTTAAAAAATAAT |
| TAAAATTAATAATTAATATTAAATAATAATTAATATTCAAGGACAAGAGTAGTCCTATCATACAAAATGA |
| ATTTAGCTGACAGAGAAACAGTAAAAATACTATTCTTTTAATTGATAGCAAATGTCCACTAATTAAAAAT |
| TAAAGATAATCAGTCATTCTCTTAGGTAAAAAACCTAGTTGGAAACTGAGAATCCTGTAGTAAATATTAA |
| GCTTTTTTGGGTCCATTGGTCATATGTGCATAATAAAGACAGTAAATTGACATAAGTATGGCCATGATGA |
| AATGTGGATAAAGCACTTTGAACTCCACAGAAGTAAGCAAATTATAAATAGATAGCATGCTCAGGCAGAG |
| AGAAAATCAAGTGCTATTTTAGCACTTGGGCTAGTGATAATTTATTGTTCAGGCTCTCCGTTTGAGTCAA |
| TGTTTATATGGCGCTGTATATTAACTGAGACCAAAATAGTCTGTACACATCACTGTCTTGGATAGATTAC |
| TGAGTGATCAGCAAAAACTGTTCCAACCCACCACTCCCCTACCAGCAAGGGATTTATAATATTTTAAATA |
| TTCGTCCTAAAAATCCAAGCTGTTTTGACAATTTGTTGGGTAATACATCTGGTTCAAAGAGAAGCGGTGT |
| GATAGATGTAATGGAAAAGACATAAAGTAGTTAACATTCCAAACTCAGGGCCCAGGTTTCCTGGATTGA |
| AAGCTCCGCCAGTTACTGTCTGTGTTGACCTTGGACAAGTTACTTAACCTCTCTGTGCCTTGTTTTGCTT |
| GCTGATAAGGTTAATAATAGTACCGACTTCACTAGGTTGTTGGGAAAGTGAAATGAGTTATTACAATAAA |
| GCATTTAGAATAGTGCCTGATGCAGAGAGAGTGTAAACTGTCCTTGTGTCTTTCCTCACCCCTTTTCCCT |
| TCTGCGTGGGTAGTTTTCAGTGACCATTCCTTGAGCAACTCCCGTATGTCAAGCACTTTGTCCCCACTCC |
| ACTTAATTTTGCAAAAAGTCTTTTGGGTTCAACTCCACCCAATTCTGGCTCACTATTCAATCCGTTTGAG |
| CAGTATTTCTTTCTTTTTTTTTTTTTTAATTTTTAGGAACGAACCTGGGGCATATGGAAGTTCCCAGG |
| CTAGGTGTCCAACCAGAGCTACAGCTGTTGGCCTGCGCTGCAGCCACAGCAACGTGGGATCCGACCCAAG |
| TCTTCGACCTGCACCACTGGGCTGTATTTTTATTTCTGACGTTGAATATATTGGATCATTTTATATTTCT |
| AGCACCCCAATTAAATCGTGAGGAAGCATCTCTCCTTCTGGGCAACCTTTTTGACTGGCATTCAGTCTGA |
| TTATATCAGAATCAGGCAAGGCTGAAGGATTAAACAGATGAGAATTTCTATGCGATGTGAAGTGTTCCAT |
| GTACCTAAAGAGCAGAACAGATGCTCAGTGCTTCCATAAAATGCATACACTGCATCCAGAGATTGTAAAA |
| TGCAGGTCATTTCCGAATCTTCTGCAAAATACAGTCTTCATTCAAGAAAAAAGTATAATAATTCTGGAAG |
| TAGCCATGGAAGACCAACTATCTGTTGGGCTGTCCCCACAGAAAGACTAAGAGACCTAAGAGGGTGGCAT |
| CATTTGCTGAATTCAACCCACTCCAGGGTCTGAACTTCAATCTGGCACCTCAAAGACCTGATTTATTCAC |
| TCTTTAAGGACAGATTGATCCATCTCTTAGGGGCTGACTCCCATTAACAGCTCCCTGGGCAGGTGTTCAA |
| ACCAGGAGGCCACTGAAGTCATTTGTGATGAGACACCTGTGTAACCTGCCCCAACCCATGCTGCCTTTC |
| TCTCAGCAGGTTTTCTTGGGAAGCCAGATGGGCTTCAGAGGTAGCTTGGTAAGCACAGAATCCAAACAAA |
| GAAAGTTAGAAAACTGGGTTGGTTTCCAGATAATGGCATCAAGGTGACTTCACATGCTTTCTCCTAAGAT |
| TGACTTGGATAGTTGGCCAGGGTTGCCATGGAAATCACCAAGATGGGGATTTCCCTGGTGGCCTAGCAGT |
| TAAGGACTTAGCATTGTCACTGCTCTGGCTCAGGTTTGAACCTTGGAATGGGGATTTCTTCATGCCATGG |
| GTGTGGCCAAAAATTTTTTTGAAAAAGGAAATGGCCAAAGTTGGTCTCTCCAGCTCTCTGACCAGCAG |
| CTGACAATCTCTGTTCTGATTGGCATAACCATCCCCTAAATACATCCGTCATGTTATAGTGAAACAGTTC |
| AGGATTAGATCCACTCTGTTTCCTTAAAGGGCCTTCACTGCTCTGTTCTGGCCACCACATACCTGCGCCT |
| GTGTGGTCCTGGAGGTGCAAGTTTTTTGGAGGGGTGCACACACAGCCACCAGGCTTTCTTCCCTGTGGGATGGGG |
| TGGCACTGCTCCTTGGCAAGCCGCCTTCCAAGGCAGCTTGAAGTCAGGCAAGAAGAGAGAAGAATACAGT |
| TATTCTTGCTAAAATAAATCACACCCCTTAATGTACACAAGAGATGGGAAAGAGGGCAGAGGAATTCTCC |
| CCAAGCACATGTTTACTCTTCAGCTATGTGATTACAGATGTCTGGATCAAGTCCTCAGACACATCTTTTC |
| AAGCGCCACCCCCCACCCATCTAAGGGTGATATTGGGACCAACTCTTCCTCTGTACTCCTGTCACATGT |
| GTAACCGTCCAACGCCACCCCTCGTCTTCAGTCACCCTTTTCAGAGCTGGTTTGCTTCTTCACGACTTTG |
| GAACTGCTCTCATTTAGAAGCAGCACCAGCTTGCCGAGGTACCCGTGGCACAGCTGAGCTGGCAGCCAAG |
| TGGAGGGCCCCATCTGCAGCTGTCTCTCATGAGGACCAGCTGTCCTGGGCCGAATGTCCCTAACCATCC |
| TGTGCCCCCTGGCAGCAGTGGCTCAGCTAATGTGGAGCCTCCTGGGATGAGGGCATGTCCCACAACAG |
| CAGCTCCTACCGGAGGCCAGAGTTCCTCACCAGGGGGTGGCTGGAGGCGCAGGCACCACACCTATGCTCT |
| TCACTCCTCATTCTTGGCCCACAGCCAAGGAGAGGGGTGGACAGAGATGTCCTGCCCTGTTACCCCTGGT |
| GGCTTTGCTCTCAGACACACTCTTGTCTCTATGCCCTCTGCTCTGCCAGCCGTTCATGCTCCACTTGGAA |

-continued

Sequences

AGCTTCATGTTTATTATCCTTTCCCAGTCTTTCCTGGTCCCTGGCAGGTAGTGGCTTTGAGCCCACCTT
CAGTGCGACATTGATGTGCCCATTCATTGGGGATCTACACGCACCAGGCTTTGTACCAAGTGCTGGAGAC
ACAACGTATGCCTCCACGGCAGGACATGAACTCACTGGGCTATAGACACCTCCCTGTGCTCTGGTGAGGC
CCCATTTCCAGCCCATGTCTGATAGGTGGCAGTCTGTATTTCACGAGGAATCCTTTGCAAGGAGTTGTTC
TTATCCTTAGACAAATGCCCAAAGAGGGAACGTGAGATGGTGTTGGTCTAAAAGACTTTCTTAAGGAGTT
TGGGGCAGAGTAGAACTCTACGTAAGATTTTCTGTCCTACTCGGGTATGTATGTAATAAAACCAGGGAGC
TGGTCTACAGAATGGGCGATGAAGCCAGTTTTACGGTTCCCTTTATGGCACTGGTCTCCCTGGGAGAGAG
TTTGCACAGCCACTCCTGCTCCAGGCTGTTTAATATGCAGGGAGGCCGTGGTAGCTGCTCTTCTTCCCAT
CACCTACCCTGTGGCCTCCCCCGATCCCCAGGGAGCAAGACCCACCTCAGAGACCAGCCAAGGCACACTC
TGCCTATCCTGGGGCTGGACCTTCACTCTGTGTGATCAGCTGCTGTAGCTGAATGTCTTCTCAGCGGATG
TGGCTGGAACATCACCCAAGGCACTTTATGCATCTTCATGGGGCTCTATGTAAAACAGTGGCCAGTGAGG
GTTCCCATCATGTCCCAGTGGGTTAAGAATCCAGCTAGTATCCATGAGGACAAGGGTTTGATCCCTGGCT
TTGCTCAGTGGCTTAAAGATCTGGCATTGCCACAAGCAGTGGTGTGGGTTGCAGGTGCAATTCGGATCTG
ATGTTGCTGTGGCTGTGGCTGTGGCCTAGGTCAGCAGCTGCAGCTCCAATTCGACCCTTAGCCTGGGAAC
TTCCATATGCCATAGGTGCTGCCCTAAAAGAAAACAAAAAAATGCAGTGGCCAGTGTAGCCCCTTCTTCA
GCATGAGAGTGTCCAAGTGAGTTTCTGGATCCTGCAGGTTGTGTCTGGCAGCTCTAAGTAAGGCACAGAG
CCTCCGTGTAGCTGTGCACTGGAATCACCCAGGAGTATGGAAAAGCCTGATGCCCAGGCTCCATCCAAAA
CAAATTCCACCAGGTTCTATATGGGTGGTACCTGGAACTCCCTGAGTGCTTATGTGAGTGATCAGTTTAG
CAAAACTGAGGACTAACTGCTGTAAGGAAAGGAGAAAGGATGACGGCAAAGCAGGATGAGAGGAAAGAGG
GGGATCAAGAAGAGAAGAAATGAAGGGCTACCCGGAGAGAGCCAGCCAGGGTCTAACCTACTGGTGTCTGGTGC
TCCCCATGAAAGGGCCACGTGCCAGCCCAGCTCCCAGGAGGGGAATGTGAGGCACTGAGGCAGCACTGGA
GTCCGGTTGTGATCTGTGTACCAGCTGTGTGTCCCTGGACATAGGTGTCACTTGACCCTCCCTGAGTTTC
CGGTTCTCTGATCCTCCCTGTGGGTCTGTGGGGTGGGTTTGATGGAAGGACCGTAAGGTTGGCACGTGTC
AGGCATTCTGCAAAGTGATAGCTTCATAATAATAAGCATTAGAAGAAATTGCTATTTCTAGTCCAACAAA
AATTTGCCAACTCTTCTCCTTAGTTATTTCTCTCTGCTGGCAGACAGTTACTTCTCCCTGAAAGGCAGCA
GTTCTGAAATATTCGTTTAGGACAGCTAACACAAAGGACAGAGGCCCGAGGTTAACAAAAGGACCCTAGC
ATCTGTAATTTCACCAACCTCTGGGGTGATTCTGATACAGCCAAAGCTGGGGAGCCTCTCTGTAGGTATC
CAGGTCTTCGCTTTATGGGGACAGGGCAGGGTCGAGTGGAGGTGCCACACCTTGATGCTCTGGCACAAAC
TTCACCACCTTCTACTTCTTTGCTTTCCCTCCTACTTACCCGAACTTTCCAATGATTTTGGTGAACTTCT
GCCCCACTGCAGCATCAAAGAGGGCCAGCAAGCGCACGGCAGGGTAATTTTGGCCAGGTTCCACCTTTCA
TTTACAAGTCAAAACGAGACAGACTCGAAACCCAGCATCCTCCGAATTAGTAACCCCTGGCCAAACAAGG
CAGAAGCCCTTTCTATTCTGACTGCAGAGGTAAGACTGAGCTGTCTCTCCCCCTTTTTGTACTTGACTTC
CCTGCAAGCATCTCATTTGGCGCCTTCGATCAGCTACGGGAGTGCAAAGTGAAACAAAGCACCCTCTCAG
CATTAATATTTATTTTTAAAGGCATGAGAAGCCCCTTGGACCACAGTGAATCAAAAGGTCTGTGCCCTGA
CCAGTTTCCATGGGCGTCGTGAGAATGTTGGTCTGTGGGAGCCCGCAAGGACCCTCAGTGGATTTATTGC
TTATTGTTTTTGTTGTAACTATAATAGGAAAAAGGATGGTCTGCCCCTGGGAGCAGCTACTGTGGGGCCT
CTGCTCCAAAGGCCTGGGAGCCGGAGGGCTGTGGAGCAGGGGTGATGGAGCCCTGTAACTTGCTAGGGGT
CTGCGGAGGATGGATGGGAGAGCATTGCCTCTGCAGCATCGTCCCTGCCACTTCTCTGAGGCAGAGTTGT
CACTAGGAGCAGCCTGGCTGCTCAGCGGGCTGGTAGCAGAGCATTCACGTGGCCCTGGTCAGCCTGGGAA
AGTGGAAAACGCCATGGAGACTAAGCCCAATGGGGTGGACAGGCAGCCGCCTCCGCCCCTCCTCCCGGGC
AGTAAATGCTGCCCCCAAGCCGCTGTCTCACAAGAGAGCCAGCCAGGGGTCATTTTCCATTTCATGAAGG
AGGAGAAGGGATTCCTGCTGCAGTTTTTGCCTAAGGACAAGAATTCCTAGCAACACCAAGGGCTTCTGCT
TTATGGCGGAATTTTCCTCTCTTTCTTCCCCGCTCCTCGAGATTTGGCAAGGGTGCTGGTGTTCAAAAAG
CAACTTTATACATGAAATTTATCTTCCTGCTACTAAAACTCATTTTTCATAACCTATCAGGGATTAATGA
AATATCTGCTAGGAATCTTTACAGGAATTGGAAGAGAGAATTTTGGAAGGAGGGAAAGAGGAGGGAAT
GTTTCAGAAATGTAAAAGTCATGATTAAAAAATCATGTCAAAAACGGTGCTTAATTGGAGTTCCTGTCAT
GGCTCAGCAGTTAATGAGCCCGACTAGTATCCACGTGGACGTGGGTTTTGATCCCTGGCCTCCCTCAGTG
GGTTAAGGATCCGGCATTGCCGTGAGCTGTGGTGTAGGTCGCAGGTGTAGCTCGAATCAGGCTGTGTTGT
AGTCTGGCAGCTACAGCTCCGATTTGACCTCTAGCCTGAGAATCTTCATATGCCGTGGGTGTGGCCCTAA
AAAGACAGAAAAAAAATGGTGCTTAATTGATAGATAGCATAGGTTGCCCTATGCTTATTTAACGGAGACC
CTGGAGTTCTTTCATGAATGAAGGGGGTATTCAACATTCACCAGAACATCTTTTTGATACGTGTCAAAAT
ACAGATATCCCATGGGGTGAGAAAACAGAAAGCTAAATGAATGAACAATCAGAAAAATGGCACAACAATA
ATGATATTCCGTATCTATTAGCACCGACTATGTGTGAGGTTCCATTCAAAGCACGGCACATCTTCATAAA
CACTCGTTTCATCTCCGTAAGAACCCTTACCTGTAAATTAGATGCTATTATTATCCTCTTAGAAAGGAGG
ATGAGCCAATTTGATAAACAGCTCTTGACTTGAGCAGTCAAGGACTATCTCTTCAATGTCAGTATCCATC
CCAAGGCCAATGGATGGATATTCAGACCTGGGAACAATCAGGCCCCTTGATGAGATTCTTTCTTCCTAAG
GTGGAGTTGGGGGCCCTCCCTCCCACAACCCAATATGTGGCTCACTGGGAATCAGAGCCATGAGATTTGA
ACTTCCCCAGCATCACTCATCTTTCGTCATCTTTACAAATGGCACCAGAAGGGAGACTGTGGAGGGGCGC
TTATAGAGAGCCAGCATGGGCTCTTCCAAAGATTTGGAACCAGATGAAAGACTCGGGGGTTCTGGAGGGA
TCCAGGGCTGCCTTCTTGAAAGCTGGGGTGTCCTGCGTGTCTGAGAATCTGGCAAGGGCACCAAAGCAGG
CAGCTGTCTTAGAGCCTATTTCAAACTCTCTAGTCTTCTCTGTGCATGCCTTGAAAAACCGCTATGCTTT
TTCTTTTCCCCAACGGCAGTAACTGCTGAGCACCTCCCTGGCTCTCAGGAAGTGTTCATTGGTTGGTGGA
CCATTCATTCTCGCTTCCATTGCAGAATCTTTGTGTGTCAAGTCCAGGAAAGTGGGTTTAAACAGTGGGT
CTCCTGGCACCCATGCTGTGCTTCAGGAAACCTGTTCCGAGATTCTCAAGCAGGCTCAAGCATGGAAGTA
GAGAACAAGCCAGAATATCCATGCTGTTTTATTTTATTATTATTTTTAAATCACGAGTTTGTGCTTTTCC
GTTTGTTTTGAGTCAAGTCCCACGACTTTTGTGATCCCCAAATCTTTTCACAAATTTATTCATAACTGGCT
CCCCCTCCCCAAAACCCTTTCCCGTCCCCCCCTGGGAAACTGCCCTTTAAATTTGCCATGGCAGGCAGTG
ACAATTTCACAACAAAGCAGGGAGTTGGGTGGGTGGGTGGGGAGAGTTTTGTTTTCTGCTCCCATTAAGA
GAGCAACTGTTCCCTCTTTGTCCCATGGGGCCCGCTCTTGGCAGCAGACTGGGGAGACCTTGAATTTGGT
GTCGCAACATCCATACAGACCCGGGTGAGTCTGGGCTCCTCGAAGGTGAATTGCAGCTGTTTGGATAAAA
TTCTAAAATCTTGTTTGTGCGATTTTTCGGCCCTTGTTTTACAATCGCTCTTCTTGGCAGAGAAACCAGG
AAGTTTTACTTTCCCAGGATCGCAGGCAGGTAATTGTTTTTCCCAAACTGCGTGTTAATCTCGGATGGAA
ATGGACATTCTTCCCCCTGAGAACCTTTGCCCGTGTCTATAAACCGTCTGTATTCTCCCTGTACTTTGGA
TTCAATCCTGAGACTGGATCACAGCCCTTCCCTCGCTTCTCTAGATTCACTTCTATCTCTGGTTGTAATT
TAGGGCCATTTACATTTCTGAACAACAGTTATGGGCTTTTTAGTCTCCTAGAATCTTAGAGTGCTTTCCT
GTTAAGTGGCTGGCCTTGACCAGGCAGCCTGTGATCTCCAGAGTTAAGAATTGGCAAAATCGGAGTTGCC
ATCGTGGTTCAGTGGTTAACGAATCCGACTAGGAACCATGAGGTTGCGGGTTCGATCCCTGGCCTTGCTC

-continued

Sequences

```
TGTGGGTTAAGGATCCCGCATTGCCGTGAGCTGTGGTGTAGGTTGCAGATGTGGCTCGGATCCCACATTG
CTGTGGCTCTGGCGTAGGCCAGTGGCTACAGCTCCAATTTGACCCCTAGCCTGGGAACCTCCATATGCCA
TGGGAGCAGCCCAAGAAATGGCAAAAAGACAAAAAGAGAAAAAAAAAAAAAAAAAAGAATTGGCAAAAT
CCACTTCTCGATGCCATTAAGTAGCATATCTGAGATTGGCTGGTCGTCTAAGCCACCACCAAGCAACTCC
AGGGCCCCGGTCTCCTGTGGGTTTATCATGAGGCCCCTGTCTCAAGGGACACAACCCAGGAAGAGGACCC
CACAGGCCCCAATTCTGCTCCAGCATTAGGACTCTGAGCTTGAGAAAGTAGCTGATGACCAAACACCATT
GAGAGGGGCGTAGGTCCTGTGTGGCTGTGTGGCAGGCTTGACAGGGCTGCTCTTTGGAGGGAGGTGGGGA
GGTGTGTTCCTTTTCCTCCCTTGTCACTTCACCAGCCCTTTCCAGGGGAAGTGTCACCCTGCAGGCGAGG
AAGCTGGAAAGCTTGACTCTCAGACACTAACTGGGACCCTGTTCCTCCAGCCCTTCTGAGACCCCATCGC
AGCTTCTCCCCCAGCACTTGGGCTGTGTCCAGAGGGTCACTAAAAACAGGAAAATCAATACACGTGAAG
GGAAAGTCCAACTTGCCAGAATGCCTTTATTATTCATCAACAAACATCCATCCATCCAGTCTGAGGCTAG
GTCCTCACTGGATAGGTCCTCATCCAGTTTAGAACAGAGTGAAGATTCCAGGCCAAGGCCACCTTCTACA
GACGCTAGGGGAGGTGGGTGGTGAGAGGCACAGCCAGGAGGACCTCTTGGGTGACAGGAACTGGCCTGT
GGTCTCCTGAGGTGGGCCGTTTAGGAAAGAGTGAGAAAGAGGGAAGGCCTTCGAGGCTGAGGGGACAGCA
TGACGGGGAGGTTCAGGGTGGGTGCTCAGAGCAACTGCAGGGGACCCTCTGGCCTATCACCACAAAGGG
AACCTGTGCCTGGAGTCAGGCCCCAGGTTAGGTGTTGGCCTTTTAAGTGTGCCGTGTGCCCTTCTTCATG
TTGTAGTGAGGAGGTGAGTGAGATGAGATAGGCAAAGGTGTGGATGAATGCTAACTCTTCACCTGCCCTT
AGGAAAGGCTTGTTTGGTACATTCTGAGGGAGATCCCAGGAATGGACTAAAGTCTGAGTATTACCGCCCT
TTCACTTACCCGCACACCTACTATTCACTCACTCACTCTTCCTCTCACCATTCACTAACTCATTCATTCA
TTGTTTTATTTACTCATTCACTCACTTGCTTACTTGTGCAGTCAACAAACATTCTTGAGCAAGCACTTC
CTATGCACCAGACACTGCTAGGCAGGCCAACTTCCTATCACAAGCCAAAAGCAGGAAGGTTTTAGAACCC
TGGTCTCCAGATGCCTGACCACCCACATCGGCCTCCTAGGCCCCCCTCCATGCACTCAGTGGGTCCCGAG
CGCCAGGAAGGTGTGGAGAGAGGATGAGAGGCAGACCCATTTCTCCAGCCAGGTCTCATCATTGTGGAAA
ATACTGATTAGTCTGCAAGTGATTTTATCACCAGTGTTCTCAGAACATCACTTGGTTTTCCATTCCCTCCGCTG
CTCCCTCTCCTCATAAAGTAAGGTCCCTTCAGTGGAGCATGCAGAGTGCTGACAGGCACAAACTGTGTGG
CTCACCCGGAGAAGTGCACAGCCAGACAGCAGTGGAAGTAGTTTGAGCTTAGATCGTTTCTGAAATTTAT
CTTTGCTTGAAAATACCTTCTACCATTTTCACCTATTTTCCCAGCATCCCAGGGCCACTGCATTCCCTTT
ATCCCAAGTCAGATCCCTGGTGTGAGAGTTCCCTTGTCTCAGGCTTCAGGAGTTCTATTATCTAAGGAAGGAAA
TACCCACCCAGCCCCTGGTCACTCTGTTCTGAGAGGTACAGGCCCCATGCAAAGTTCAAGAATAGAGGTC
CCTTGTCCTGCAGGGTCTAAACACGTGTCTAAATAGATCACCTCCTGAGTGGTTCCAGTATCTTTTCTGT
CCCTTGTGGCATGGGCTCCAGGCAACCTTGTCTCCATGAGACCATTTTTGGTCATCTCTGTCATGGGGGG
AGGAGAGAGCGGAGGTCAGAAAATCCAAATTTGAATCTAATCTCTCAACAACCGGCTGACTGGTCCAG
GTCGCCACTTAATGTCTCAGAGCTTGAGTTTCCTCACCTTTGAGTTTCCTCTTAAACCCATTGGTAAAAT
AGGTTTAGCACTAATCGGGACCTCAGATGAACTAGCCAGGGCTGGAATTTATCTGGGAGTTCCCTGCAC
AGCTGTGCCAGTTGTTTACACCCAGCTAGTCTGTTGTGATTGGCTAGGGTGCACACCATGCTGGTTGTTA
ATTATTTTGAATATGACTCCCTGAAGCCATAGGCTTCCTAATAAAGGGTTCTATTATCTAAGGAAGGAAA
CCCTGGGTCTTATGTCCTTTTCTATGCTAAAATTCTTACTACATTTTTCTTACTTAAAAGGAAACTCTGT
CAAATTTGACTATTGTCAAAACTCTATAATAAATATTTATGATTACTACCTTCTAAGGTTTCTAAGCTCA
GGAATATATCAAGTGATTAAAAGTCTGATATAAAGAAAGTTTTTATATAATTATTATAGTCCAGAGTATC
ATGGTTCGATATATAACAACTGGGAGAATTTTATATGGACATATATCATTTTTTTCCTTTCAATTTGTTTT
ATGAGGGATAGTTTTTCATTTCTCACTTGTACAGGGTGGAGATGTACTTTTTTCCTTTCAATTTGTTTT
CCATGTCTATTTGGAGGAACCAAAATAGGAAAACCACTACACAGGTCCTAAAATTCACTTCCTCTATCCG
TTTTCTGTACTCTGCTCCAGGTCTGATGAATATAACTTTCTAAACATGTCATTTATTTTTATTTTTATTT
TTTTTAGTCTAAAAGTCCTGTTTAGAAACACCAAGGGGAAATATTTTTAGCTTAACTAAGAAAACAAACA
TGTTTAAACAAACAACATCCAAAATGCTCAGGTAGAGTTGGTGTGTTTTGGCGTTTGCGTATTTTAACAGT
GAGCCTGTAAGATATACCCTGGAACAGAATTTTTCTTCCTCTTAGATGTGTTAATTTCTTCCAGGAGAAA
GACAAAGAGAACAATTGATCCCAACTTTTATACTGGAGGAAACTTTTCATTGTTTGAAAGGTAGTTTCAA
GCTAGACAATATGCTGCCCTCCCCCAACCCCCAGTTTTTAATTGCTATTTGTAGGCATCCTGTGCAGAGC
CAGTGGAAATGCCAGTAATGGTGCAAATAAAGAAAAAGATGAGCTAAGATAAGAATGAATGCTGAGTTGG
ACCCCATTCGTGCACCATAAAGATTGACTTTTCTGCCTTCGTGACCTCATAGGAAACTTTTAAAATGTTC
AGGTAGAATTGGTGGCTTAGAGCTCAATACTTCCCATTTTGATCCCTCCTCTAAGGACCTGATCCTTGGC
TCCATGCAGATCCAAAGCGGGAAAATGATCATCTTGTGATTAAAAAGCAAAATCCATCTCACCAGCTCTT
CAGGGCCCAGCAGGCCCAGCATCTTTAATATCAGATTGTTCCTGCTCCATAGACAGATGAGTAGGGACTA
ATAATATTGAATGAGTCAATAATGTTAACTGAGTGAGTAAATGAAAGGAAGGAGTTCCAATTGTGATGCA
GCGGAAACGAATCCAACTAGGAACCATGAAGTTGCGGGTTTGATCCCTGGCCTCACTTAGTGGGTTAAGG
ACCCAGTGTTGCCATGAGCTGTGGTGTAGGTCGCAGAAGCGGCTCGAATCTGGTGTTGCTGTGGCTCTGG
CGTAGGCTGGCGGCTACAGCTCTGATTGGACCCTTAGCCTGGGAACCTTCATGAGCCGCAGGTACAGCCC
TAAAAAGACAAAAATAAATAAATAAATAAAAGAATGAATAAAGTAATTAGCCGGTAAGGTGCTCCA
TCCATCTTTAGAACTTTAGATTGTATCTGTTCATTGGGTTTTTAATTACATAGACCAGGAGTAAGCCCAG
CACTTTGTATTTGGGGGTCAATGGAAAAAAAAATCTGTGCCTTGGATGTGTAGTTAGCCCAACTTGAG
GTCAGAGTTGAAATCTCTGCTCTATTCATTATACACTTTATCTCTATCTCCTAGAACTTGAAGCATGTT
ATCACATATATTTGACTTACTTTATTCCAAAAGGCTCTCCAGTTTCATTTTACCTGTTGCATTGTGTAGC
TCTTTTGTGAATGCACTTAACTAAACTGGTACAATAATCAATGACATTATCAAACTGTTAGTGGTTGTCA
GTAATGTCCCTTCTCATCTCAGGATTATAAGTGCTTTTCTCTTGCGAGCCTGCTGAACCCTGTTGGGCCC
CCAGTTGCTAAGCATTTTCATTACACTTTATCTAAATTTATCAGGATCGCCTAACCACCCTAACTGGGGC
AGTGAATCCAACTCATTCACACCCATATTGGAGAGTTGCAAGATGGACACTATGAAATGTATCAGTGGGCT
TTTTAAATCCTTGCACTTCCTAAAAGGTTAAAAGGCCAGTTCTTTGAAATTAAAGATTTTTTTTTTTTT
AACCCATTAGGCCGACACGGGGACTAAAACTTGAAATGTATGCATCAAACTATTGGCAGAGTGATATAT
CCACATCACACATGGCTATGAATATGTAGTCAAAACATGGATTTTAGACTCGTACAAAAGAGTTCACTCT
GAATTCAGAGTAGAAGAAAATGTCAATTATAACAATGAGAAAATCTTACAGAAACTCAGTTTATAAGCGT
GTATTAACATTATGTCATAGGAAAGTTAACTCTTCTCTAGTCTTCTCCAAAAAAGCCTATTTACCGAGAA
TACCTAATGAAATGGTTGTCTTCTTAGACTGAGTTTTTGGGAGAAGGCACCTAATTGGTATAATTCTCTT
TGTACCGATGCCCAGCTAACTGCCAGCAGCAACACAGTGATCTTCAGTGACAAGCCTGATTGATTTCATA
CTCCCTTTTCACATTATCATAGGCACCTGTGTTTCCATATGTGCAAAATAGAGGTACAAGTGAATGAAGG
TTTCAGAGGGTGCAGGCAGCCCAAGATTTGAAGCCTCAAGTGTAAAGCGGGGATACAAGGGGAGACTTGG
AAAAGGACAAGAAAGCAGGGAAAAGTACTCCAGAAATGAGACCCACCTACTGGTGATGCGTCAGGCTTCG
ACTCTGCATCTCACCATGTGGATCCCCCCTGACCTGGGCCTGGAAGCTGGCCTCTTCTCCCCAAAACACC
```

-continued

Sequences

AGAGAGGAAGCAAAATGTGGTGCCACAGAGCTCTGCAAGGATAAGTCAAGATCAAAAGCACCAGATCAAA
AGAGAAGCAGAGCCCAGCCACCCAGGGTATTTTCTTAAATTAAAGAATAGTTGACTTAGCATATTGCACC
AATATCTGCTATACAGCAAAATGACTCAGTCATATATATATATATATATATATATATATATACATTTTTTA
TATTACTTTCCATCATGGTCTATCCCAGGAGATTGGATAGTTTGTCCAGGATATACATTGCCAACAATGT
GCACTTATTGTGTGCCAGGCCCTTTTCTAAGCTCTCTGCTGTATTATTGTATCTCATTTAAAATCCAGGT
TACTAGATGCTGCCCTGTCTGCTAGGTGTTCATTAGCTCCATGATTTATTCATTCCTAATATAATACTAG
CTAACACAGAGCACTTACCAGATGCCAGGCACTGGTCTAAGCATACTACATTTAGTAACTCATTTAATAC
TCAAGAGAACTTAATGAGGCAGGTACTGCCATTATCCCCACTTTACAGATGAAGAAACTGAGGCACAGAG
ATCCTTGAGCACCTTGCCCAAGATCATGCAGTCGTAAGTGGCTGAGACAGGATTAACCTGGGTTTAATTC
TTAGCCACCATGTCAGGCTTCCTCAGGTGCTGACCACTGATGATAATCACAATATGGCCATTGATTATTT
GACTCTGGTGGTTATAATCACAAAGAAAACATCAAACATGTAAAAGAATATAAGCAGATCACTTCTGCTG
TCCCTCAAAGACCAAATTTTAAATAGGGTTAAAGTTATTTTGTTAAGGTCCATTGGTGTTGATCCCTAAA
AAGAAAAGCAACTCTTTGCATTTAATTGAGAAAATAGGCCTAGTTGCTTTTGATGACTCCATAGAAGCAC
CCCATGGAATCAGGGAACGAACATCACCAGACATTCTTGGGTGCCTATGTTGCTTGAAAATCTATGAAGC
TCTTGTCAAACGTTAAGAATCAGGAGTGGAATTCCCATCGTGGCTCAGCAATAATGAACCCAACTAGTAT
CCATGAGGACACAGGTTCAATCCCTGGCCTCACTCAGTAGGTTAAATATCCAATATTGCTGTGGCTGTGG
TGTAAGCCAGCAGCTGCAGCTCCGATTTGACCCCTAGCCTGAGAACTTCCATATGCCACAGGTTTGGCCC
TAAAAAGACAAAAAAAAAAAAAAAAGGAATTAGGAGCTGGAGCTTCTCCACAACAGTACACTAGAGCCTC
AGAATCAGACTTATTGATTCAGTGCTATTAGGGCAATAAACAGCTCTTATCAAAGACAAATAAGATAAAG
GCTCAAGACGAGAGTTCCCACTGTGGCACAATGGGATCAGTGGTGTTTTGGGAGCACTGGGACGCAGGTT
CAATCCCCAGCTTGGCTCAGAGGGTTAAGGATCTGGCGTTGCCGCAGGTGCGGCTGAGGTTGCAACTATG
GCTCAGATTTGATCGCTGGCCTGGGAACTCCAGATGCCTCAGGGTGACCAAAAAGAAAGAAAGAAAAAA
AGAAAAACTCAGGATGCCTGAGGCTGCCAATGTGTAGGACACAATGTTTATGTTCAGCTGTTGAGGGTGC
CCAGCCCCTTTGGTTTGGATTCCAGTATAGAAAGTGCAGTAATCACTGGTGGACAATGCTTCTGGATACC
ATCCTCAGATTTCCTTTCCTCTCCCCAGGGACATGCAGACTACCTAAAAAGCCCTGACATTCCAGGACAA
CTTTATACTTAACAGAAGAAGAGGGAACCTTTGGAAATTTATGCTACAGAGACCAAATTAATTTACCAGT
GAAAGGAGCAGTCTCCATGTCCTTCCAACTGGAAACAGATCAGAAGCTTTAAGGCATTAGAAAATGTAAG
CTGCATAACGAAATTCTGAGTCCAAGCACTCATGGATTTTGGGCTCTTGATGTCAGCAATGAATGATTG
TAACCCAGGTGTGACTCGCAGTGCAGCCTTGGCAGGCTTTATTAGAACGGCAGCCAGCTGCAACAGTGAC
TTCTGAGAATATGGAAACAGACCCTCCAGGGCTGCCATTTCTCACCTCAGCTTTTGGCCTGGGCATCCAG
TCACAATACTGAAAGGGTAGCAGCGGCTCAGGGTCCAAGGACACTCAGGGGCTCTTGGCAGCCAAGGACA
CAAGGATCCCTAAAAAGTCCTCTAGTTGTTCCCACTGCCTTTGGGCAGGACCACCTAACCTTTCGGACAG
ATAAGAAGACTCCTGGTTTTAAGACCTCCACGAAGGGATTGCAAGCCCCATTTGTTAACTTTCACTTTAT
CAAAATGATATTTGGTAACTAGGCTGTCCCTACAGCAAGGACAGGAACCTATCTTAGAAAGTTATGTGAT
TTAAAATGTTTTAGATGGATGGATGGATAGATGGTGGGTGGAGAGAGAGAGGTAGGTAAATAGATGAT
GGAGGAAGGATGGGATAGGGAGAGAGAGAAAAAGAAAGAGTGACTGAAAGAAAGACAGCT
AACTCCCTAGCAATGAGACATATGAAAAATATTTATGATGGAATTATAAGCTGGAGAGTCCACTAAGACC
CGTTCAAAACAAATGCTACCTTCCGTCATGCTCCTCAGCATTTCCCACATACCTCTATTATAGCACCTT
ATCTTGTTGCAACATTAGAATTTGGATGCTGTTGATCTCCCTGGCTGGAGTGTGGGCTCCATAAGTCAGG
AATCCTATCTTATTCTTCTCTGTAGTCTCAGGATGTAGCCAATGCCTAGCACCATAATTCTGTTGTATGG
TCTCAGACAGTGAGAGCTCATGTGACTAAGAGTAAGCTATCTCTGGACCAGTGACTATTAAAGCACCTT
ATACAGATGTCCTCAGCAGTGGAGTTGTGTCTGCATTTCCATCCTTGAGTATGTTCTGTTTCCTCTGACA
CTCGGCCCTTGACACAGGATGACGGACAAAAAGCGTAGGAGTGAAAGGACCAGCTCCAAGTGCCATCTTG
GGAAGTCGAGGGAAGGATCAGCTGGCAATCCAGGTTGGCTGAGAAGTCCTGTGACCTGGTCAAGGGTGTC
ATCAGGATCTCCGGAGCCTGGAAGGAAGAACCATGAAGGGAAGTGGAGGGAATGGGGCTAGAGGCATGGA
TGACTAGGAGGGGGTTCTAGGAGAACAGGAAGTGACATGTGATGGTAGGGATATCATTGTGACTCCATAT
GCCCAAGATCACGTCCCAGAGCCAGTCAAGGATACATATATATAATCCTTGCCCCCCCCACCCCCCCGGG
CTCCTGGCAGCCAATTCACCTGGAGTGACTCCCCATCCTTCTCCCCAATCCAAACCCTCTCATCTTTCAA
GGTACAATCTGAGGTTTATTTGGCCAAGTGTCTCCTCCTCCACAGAACACCCTTCTCCTTCTCTTGGCTC
CCTCTCTCTCCTCCTCGGCACATTTTGATGTCCCCCTGTTCCAGCAGCTCTCTCTTTGGCGTTGTACTCT
GCAGTCTGTGAAGCCAGGAGCAGTTTCTCACGCGGAGGGGCCAGGCTTTATGTCTTGTGGGCATGCAACC
CTGCGCAAAAATGATATTGGATTAAGCCTCATGCTTTAACAAAAAGGCAACGGGCTTGCTCTGAGGTAGA
CAGCAAAGCTTGGAAGGGAATCTGGCACAAGAACTCTGCCCACTTGGAGCACTGGTTTTTGACAGGAACT
GGTACAATTAGACCCTTCCTGGGAGTCATCTCTGTGTTTTTAACCTTGTCGTAGAGTTTGTTTGTTAGTT
GCACTTTCCCTTGGGCTGAGGTCTTTGGCATTCCTTCACTAGATCCAAAGGCCCTTGAGGACAGTCTTAC
CTAAACCTTCTTACCTTTTTCCCCCTCTGTACCTGGGCTCCCGGTGTTCGGTAAATATTTATCAAGCAGG
TGAATGTGAAATACCCGAGCTGATGCCTTCACTCAAGAAGTAAATTCTTCCCGTGGCTTCTTTTCAGGTT
GTGCAGATTGACAAGGACAAGAGAGATTTAGGATCAGAACGACCTCCCAGCATTACTGACTGGCGTAAAC
TGAGCCACTGAGCTGGCCAGTGGAGGCAGGGGTAGCATGTGGTCAAGGATGTGGTTGAAGGGATAAACAC
AGACGATGCCTGTGGGCTAGCCAGGCCTGAGAGATCTGAGTCTTAGGGCCTGGGAGATGGGGACAAAACT
GTTCCAAAACAATGAAGGCAAGAGTTCCCCTAGTGGCTCAGCAGTAACGAACCCAACTAGTATCCATTAG
GACGTGAGTTCAATCCCTGGCCTCGATCAATGGGTTAAGGATCCAGCATTGCCCTGAGCTGTGGTACAGG
TCGCAGACGGGGCTCAGATCCCATGTTGCTGTGGCTGTGGTACAGGCCTGTGGCTATAGCTCTGATTCAA
CACCTAGCCTGAGAACTGACATATGCTGAGGGTGTGGCTCTAAAAAAAAAAAAAAAAAAAGCAAAAAATA
AAAATAAATTAAAAAAAAAAAAAAGCAGTGAAGACAGAGCCAGAGACATAAAAGTGACAGTGGCAGGTCC
AGGGCAAGGGAAAGAGACACAGACAGACAGGGTTATAAAGAATATGTTAACCCAAGTGAGGACACTTCTC
CCAGGGCTGAGCAGTCCCGTCTCCTCCCCTGGGGTGTAAATTCCTCATGGGCAGGGGTTACATTTTGTTC
ATCGTGGGCTGCTCAGGACCTTGCGGGGCTGGCAGGGGGCCTGGCACACAGTAGGCTTCCAAGAATGACT
TTTAACCTGAACTGAATTGATAAAAGAGGGTTTCACAGCCTGTCTTGACCACATATCCAAGGGCCACCAA
GGTTTCCGTCACCTTGGACATGTTGAAGTTCTTTCCTTAAAGTCTAACTGTGTTTTTTCGACACAGCTTA
AATCCACTTCCTCTCAAAAGGCTTAAAACGCATGGGATGATTTTCCAGCCATTCGGGAAGAAGGAATCCT
GTGTATAAAGCCTGGATTCAATAAAACCAGATTTTTAAAAAATAGCTCTTAGCATCTTCTTCTACAGACA
CTGGTCTGGGCAAGGCTTTTTATTTTATTGAATCCAGCTGAATAGCTTGACGACATTAATAATGGGGCTT
CATTTCTAACCACTGGCTCACAATCTTTTCCCCTAAAAGCCTTATGGTACTTAAGCAACTGCTAATACAT
AAATAATTGCTGGTGGCATCATTTCCTGCCATGATTTGACCACCAGGATGAGGTTTTTCTTCTTGTACCT
AATCTGACATTCTCAAGCATGCCATGGGTGGCCTGTACGATCGTACTTAAAATACAGTAAACAGATCTC
ACTGCAGCTATGATTTGGGCTGTATGGAGTTTCTTTATGTTGACAAATTATGGATTTGGGAAGATTCTGT

| Sequences |
| --- |
| TGCGTGTATAGTAACATTCATTGGTCTAAAGGGGATTCTACCTCAAGGCTGCCCAGAGGTTTGGACCCAA |
| TATTTCTGCTGAGCATGGTCCGTGCCACTCTGTGGGGTCCTCAGGACGGACTGGAAGATTTTATTTCCTT |
| CACCTTAAAGATGCTCTTTATTTAGCTTCCACACCATCATACTGCTTTTTGAAGTTTCTCTGTAAAGTGA |
| CTTTTTAACCATCAGCTCTCTTTGTCTTGGGCTTGAGTGAGGATCGTTTTTAGTGTACCTAACTGGGACG |
| AGATGTCCTTGTGGAAGAGGGGTCCCTAAAAACACACAGCTGTTAACAGGAATATAGTATAATACCTAAG |
| AGCACAGCCTGGAGCTGCATGACCTGAGCTTGATCCCAGCACTTTCTGACCACGTGTCTTTGGACAAGTT |
| ACCTGTTCTGCCGCAGTCTCCTCCTGTCGGAAATGGAGATAATAACAGTGCCAACTTCATACAGTATAAG |
| GCCCAGATGAACTGCTGTTTGATAAATGCTTAGATCCATGCTCAAATGACATGCTGTGGAAGTGCCTGCT |
| GTTGTCTAGGTTTGTCCTTTTGTTGCATGTTCAGTGCATGTATTCCTCTCCACATAGCCTCTAAGTACGA |
| ATGAATAGTAAGGTTTATCTCTCAGCTGACATGCAGTCACATTGAGTAGCGGGCTAAAAAATAGGTAAGG |
| TAAGACTTTTGCATACTACATTTTGGGGCAAACATAAAATATTTCTTTTACCTGGGAGGTTCGAGTCTCCC |
| ATTGCTATGGGGAGAAATACGTGAGTCCCCCTGCGGCCACCCCCAAAGAATTTGCAGTCAAACTGGAGA |
| CACGCTTTTTTTTTTTTTGAAGTTTCCCTGAAAAGTGACTTTTAACCATCAGTTCTCCTTACCTTGGG |
| CTTGAGTGAGGATCGTTTTAGTATACCTAACTGGGACAAAATGCCCTTGTAGAAGATGGGTCCCTAAAA |
| ACACAGAGCTGCTAATAGGAATATAGTATATTATTATACATATCTTGTATCAAGGAGCAAATGAAACTG |
| GAGAACAGACCAAATGAAGTCTGGAAGGAGATCTGGAGGCGCAGATGCTGAGACAGCTTGCAAATAGTCA |
| GGTCAAGCTTCATGGAAGGTTTTCAGATGGGATGAGCTGAGTCTTAAGATGATGGGTGATGGAAGTAACG |
| AGGCACCGGAGGGGTGGAGCACTGGAGGGTGCTAAAGGGTGCTGGGGTGTCCGGAGGGAATGCCTGAAGC |
| CCTGGGGTGGGGGTGATTCTCTCACTGCAGGGGCAAGGAAGACACCCCCAGGATGTGGCCAGGGAGAAAT |
| GGCACAGTTAACAGTGACAAAAAATAAAGCGAGAGAGCCCAGACTTCACACAGACTTCACACACAGAGTG |
| TTTAGATTTGGTTTAATAGAAAAAAGGAAGTGAGAGGGAGGTAGGAAACACTATCTGGCGCACTTGGCAG |
| CTGTGTCACCCGACGACGTCCCTCCTGCAGCCGTAGGGTCCCCGAGCCGGGCCTCGCATATCCTCCAGTG |
| ACGGAGGGGTGCAGACCGGCTGCAGAAATTAAAACACTTTAATATATGCGAGTTGTCCGGTCCAATCACA |
| GCAGATGCCAGGAATGTTTTTCTGCTTTCAAAATGAAGTGCAGGTTGTTTGGAGGTTGTGAGGGCGTGAT |
| CCCATCTCCTCTGGGTCTGAATCTCTATGTCACAGGATGAGACAGAACTCAGACCTGTGTCTGTTTGGAT |
| GCATCCTCAGCGCACTAGGTTTTTAGGGGCTTTTCTCATAATTTCTTCATCCGAAGAGGTCGATTAGCTT |
| GTTCTCCTGTCTCTTTCCTCCTCCGGTCTTTTATGTTCTCCTGTTGGATGGCAGCCTTCATTTCCTCCGG |
| ATGGGCCCATTCCAGGCTGGGGTAAGGAGAAGGCAGTCTCCAGGGCGGCTCATCTGTGTCATCACCCGGT |
| CCCTGTGAAGTGGAGGGAAATAAACAGCACGTGGGAGGGGGGGAAATCTGTGTTCTAAGAACTGCTTTGG |
| TTTACACATCTATAGATACACTCAACCGGCCCTGCGGGTCACATGGACCAGCTGCTGGAGCTGAGCATGA |
| GTCACTTTTAAATTAGTCATAGAAAAAGAAATATGTTTCTAAAAGCCAGCACCGTTGGCTTACACATGCA |
| GCCGGGGAGTGAGCAGGCAGCCTATAAAGCACTCAGGCCTCCCGTGACGACTGGCGTGCATGGTGCACTG |
| GGTGGGGGGAATGGGTCCAGGTCTGGGAGCTCTCTGCCATCCTTGTATTTGGAGGTGAGAATCCTCATCA |
| GTGGGAACCTCTGCCCTGGAGCAGTGGGTGCTGGGGTTTGATTTTCCATTTAGCCCCTCTTTCTCTTACA |
| GCTTTGCTTTGTAATTGGCACAGGAACTCTTAAGGTCTTCAATAACACAGTCTAGCAGTGGGTACCAGAC |
| CCTCTGAGCCTGAAATAGGGGAGAAGAATGCTGTTCAGCAAAAAGGTCAGGAAGGGAGGGGCCGAGGAAA |
| GGGGGTCCAGGAGCATCGTAGAGTACATGAACTTGAGCCGAGCCTTGAAGGGCTTAGTTTGTGGTGAAGA |
| AGAAGGAATTCCATCCCAAGCAAATGGAAAAAACCATCTGAGCAAAAGAAAGCTTAAATGACAAAGGC |
| CGCACCTTTGTTTTATCCGTGGGGAGTCTAAACTTTTCACACACACACACACACACACACACACACAC |
| ACACACACACACACTAGAGAGAAGACAAGAGAACAATCACCGAGGGGGCCGAGGCACTGCTTACTAAAT |
| TGGTCCAAAGGAGGGATTTCACCAAATGCAAATGAACAAAGAACAATATGTGTGACTCAAAATATCCGTT |
| ATGCTCTTAATGTGAGAGGGTGTGAGGCAGGGAGTTGACCTTTGAAAGGTTTTAAAGTTGTAAACTTTTG |
| TAACCACATTGTTTTGATTGCTGGAAGATTTAAGAAAGGATTACCTCAGGGTACCATCTTGGAAAAGTGA |
| TTTTTAAAAAACTGCTTCCTACATCCTCTCAGGGGACTTTTTTCATTATGTTTTGCTTTGACGATGTGC |
| AATTCAAGTGTCCATGGAGAGGCCCAACCTTCCACGAGAAGCCAGGAGTGCAGGGATGCCGCTCCTGTTC |
| GACTGGGTCTCTGCTCCTGGCCCCTCTGCCAAAATTGTGGTTCACTGGAGCAGGGGTTCCCCCCAGCTCC |
| ACCCCTAAGGAAGCTCTTTTGGCCTTGTTTTCCCTCGCAGCCCCGCCCCTCCCCCTTTGCCAGTAGGTCA |
| ACATCACAGCAAAGTGGAGCCGATGTCCCTCACCCTGAATGGGTAACTCTGGGCCAGACATTCCCTGAAG |
| GTCTCCTCGGAAATTTGGGAAACAGGAAATGTGAAGAAAATGTCCAATTTGCGTGGTCATGTGAAGTCCT |
| CTTTCGATGTTGCAATAGAATTTTGGAAAGGCGTGCTCTGAGCTGTGGTTGAAGCCTCCTCATCAGAGAG |
| CGTTTGCCCCTTTGAGAATATGGTCGATTTGACTATCCCGCCTCAACTTCCCTCTTTCTAAACATGTAAA |
| CCCTGATGCCTGAAGAACAAAACCAGAAAAGAAACCCACTCGGTCTTAGTTGCATGGTCAAGTTGCCAGC |
| AGTGCTGCTGAGAGGGGCCCATGTGTTTGTCCCTGAAAAGCCCCTTGGCATTGAATAAAAGCACCCGTGC |
| AGGCGAGTCTGTGCAGGCTCACGCACCATCTTCAAACCTTCACAACCTGTGTTTGCAGTGGATGATTGAT |
| GATGAGGCTTGCTTCCCACACATTTGGCTCTGATCATCTCCATGCTAAAACATTCAGATGCAAATCATTG |
| TAAAAACCAAGTGGCTTCAAGGGATCTTTCTGGAAGGATGGAAATGTTCCATATCTTGATAGGGGAGTGG |
| GCTCCAGGGGTGTTTGCTTCTGTCAAGATTCATCAAACTGTACACAAAGAGGAGGTTCATTTTGTTCTAG |
| GTAGATTATACCTCCATGGAAATTTTAAAAATAATAAAATGGCTCGAGTTTAGGGAAAAAAAGGGGGACA |
| TGATGTAAAATGACTCTATTTAAAGGAATTTACAAACATTAAGAGTTGGCCAATAGAAACTCAGACATCT |
| ATGTGGGCAGTCCCAGGCTGTACGGGAAATCTTTGCAAGGTGAACAGATTCAGCCCAGCTTATAGAAACT |
| ACAGCTGGTTATGTGCATGCGTCTGTGTTTTCATATGTGGTTTTTTTTTTTTATCTTGATGTCCATTTTT |
| GTTTGGCGTATTTCCCTATTTGATTGGATTTTTTTTCCTTCTATTTCCTGAATATGATTCTCCCACAGT |
| ACCGAATACCCCAGGCCCTATAAAAGTGAATGCTCAATAAATGTCCACTCATCCCTTGAGATGGAGTGT |
| TTCCCCTCACTCTGGAACATTCTACTGAAATTAGCCAGTGCATGTTGGCCTTAAATGCATATGTAAAAAT |
| GGAAAGTGAAAGGAGAAACATCCATACTTGCACTAGTTTTGAGAGAATTCCCAGTTATCCCTGCTTCTAA |
| AAAAAAAAAAAAAAAAAAATCCATTTCAGAACTTTTACTTTGGAAAAAAACATATTTTTGCCCCACAGA |
| AAAATAAACTATGTGTTCAATACTTAGTGGTATTTCTTTTTAAGTAAGAAAACAGGATTCGTGATTATGT |
| CTGAATGTGGGTGAATGGGGCAAAGGTCTCCTTTGCTTTCTCTCTTTCTTCCTCTTCATGGCAGCTC |
| AGAACAGGTGTGGAAATTCCCGCAAGTGTAAACTGTGTCAGTTTACACGTTTGTATACAGAGTTTCATGG |
| TTTTTTTTTTTTTTTCTGACAAGTCAGTCTTTTTGTCATCATCTCATCTTGAAACTAGAGAGGAAGGG |
| AATGGAAGAGCGAATTGCTAATATCAGAGCTTCTGGAAATTCCCCTTTTATGGTACATGAGTCTTTCTTA |
| AGAATAGTTCTCTTTCAGTTGTGTTTTTGTGATTTGGGTGAAAAATCTCTTGTCCAGCCCTCCCTCTGGT |
| TTGCTTAAGCATGATCCCAGCTCTCTTTAGAGCAGGAGCTAGAGATGGCCAGAGGGAGGATAACTTGATT |
| TTCACTCCACGATTGGGAGAAAAAGCCCAATTGAGGTACTTTTTTTGTTTGTTTGTTTGGACTTTTTA |
| GGGCTGGATCTGCAGCATATGGAGGTTCCCAGGCTAGGGGTCCAATCGGAGCTGTAGCTGCTGACCTATG |
| CCAGAGCCACAGCAATGTGTGATCCGAGCTGCATCTGAAATCTACTCCATAGCTCATGGCAACACCAGAT |
| CCTTAACCCACTGAGTGAGACCAGGGATCAAATGCAAGTCCTCATGGATGCTAGTCAGGTTCTTAACCCA |

-continued

Sequences

CTGAGCCACAACAGAAATTCCTTGAGATACTTTTTTAAAAAGTAGATAACCTGAGTATAAACCTATATTC
ACATCACTTTAAATCATTAATTTCTCCAGTATCTTTTGTAAACTGATGATTCTCACGTGAACGAACGAGT
CACCAGTTCCTGCATGGTGACTGGCAGCTCTATAAAAACACTATTGGCATGTTGTGTGTTAATGGACACT
ACCAGGTCCAGTTACAACAACCTGGCTTAATGGAAGCTGACCAACCTGTTTTCAAGTCAGTACAATGCAA
GGTGATTTTCAAGCAAAAAAGGCCTCTTTTCCCACACACCTCTTCTGAGGATGCCTTCTTGAAAATGGC
AGTAGACTTTGGATTCTGGGGCTAGAACAGGCTTCCATCCCATATGGCCACAGGGGGAAGGGCCCCCAGA
GGAAGGCAGATCTTGCTGCTCTTGGGACCGGCTGGCAGGCTGCCTGAGGGGCTCAGAGGGCCCCGGCACA
GACTGAGGCCTGGAATGTAGGAGAGCGTGTGACAGCCAGTCTCAATGCTGGGCTCTGAGGGACTATGCTA
ATTAGCAAAATGCCGGGTCACTGGGCGGCCAGGTAAACAGTATCAGGTTGTTTCTGCGTTGGCAGAGTGG
GGCAGTGCTCAGAGCCTCCGCTGAGAAGCTGCTCTTGGCAGTTACTTATTAATTGCACCTAGAGGCACCG
TTGGTTTAGACAAGGGAGATACTCCTCCAGGCAGTCTCGGCCTTTCTCACTCTCCCAGCATCTTTGCAGT
CCACTCCTGCAGCGTGGGAACCAGGAGGGCCTTCCCCCCAGGGCACTGGTCTGAGGACAGCTAGCCTCCC
AGGCCTCTGGGGGCCATGGCCCCTTCCCACCTCTGTCACAGGAACACTAGTCTCTAGGCCAGGTGAGTGA
AGACCCAGTGGGAGCTTTTCTTATGAAATATCTTGACTTCTGAGTTTCTTTTTCCTGCTACGTTGAGCCC
CGTGTATGTTTGTTTTCTTTCTAATTTTGGCTTTAAAAAAAAAAAGAAAGAAAAAAGAATGTTTGGGTAC
AGTGTAAAAGTTTTCTCATATCCAGACTGGAAACTCCCTGGTCACCCTGAAACCAGGCAGGTGTCTGTTT
GTCTCTCTGTCAATAAACAGTGTGTACTTGGCCTGGAAACCCACCCCGGTAGTCATGGTGGGCCTGGCCC
ATCTCTGTGTTTGAGGAGGTTCGAGCCACCCCCACATGACATGGGAGCAGGGCCTGCCTGCTGCTGCTCT
TCTTTTTTTTTTTTTTTTTTTTTTTTTTTTTTGATCTTCTGATAGAGACCACATAGTGTTCCCTTCAT
GGTATTTTGATGACATATGACGTATAAACACAGGTGTGACCTTTACGCAGTGACATGGGGTTATAATTATA
ATAAGTGAAAGAAAATAAAGCCAACTGGAGTTCAAGGTTAAAGTCAGAAAGAGCTAATACTAATTTTCAC
TGAAAATGGTGTCTTGGAGCAACAGGTAGCTCCCCCTTCCCCGGAGACTCTGTTCAGTTGCCTCTTGTGT
CATTTTATGAAGTAACCCCAGGCGAAGGGTTTCCATGAGATAAGCCATCTCGTGAGATACAGACATACCG
GTGACACTCTGAGGGCCCCCGGTCTGCTCTCCTGGTACCGTGGTGGATGGAGGGCAGTGTTGGAGCTTCT
GCTTAGGACAAGGCATCGTGAGCTGTCTGGTCCCAGCTTCCACCCTGGCTGGCATTTTCCTTCTCCAGGA
TCCAGTTTCACTGCTTAAAACATAGGGGACTTGGCCCCTAACCCATCTTCTTGCATCTTGGTTTTTCTA
GATAGAGGACACCTAACCCCAATCAGTTTCTTAATTTCTCAGGGGGGAAAAAAAAAAAAAAAAAAAAAAAA
AAACCTGTCAGACCCATGAGTAACTTAATTGTTGATTTGTACGAAAGCTTTCTTATTTAGCTCCAGGATC
GCTGTCTACAATGTGAAGGAGGGTGGCCCCTGGCTTGAGTGTTGCTGTGCCTTTTCTCACTGAGCAGC
CAGCTCAGAGGACAGAAGGTGGAGAAGAATGGAAGAAAGAGACCCCGTGGTTTACTCCTCCAGCCTGGAG
CTGCTTCTGGGCAAACGCTTTGACCTGCATCTCTGGTGGCCCAAGAAATGGGGAAATCGGGGCTCTGGGC
ACAGAGCCCATTGAGGTTATGAAGTCCACTGGTTTGCAGTTACTGAACAGCAGAGCCCCTCCACC
ACCACCACCCCGCCTCCCGCAAAAAGAATTAGGACTTGGAAAGGGATTCCCAGGCCTTGGAAAGAAGCCT
ACATTTCTGAGTGTCAGGTGGACATGCTCAGGTCTGGGCAAGGTGGGGGAGACCCAGCTCCGGGCATTTG
GGTAGAGCTTACTGATGTTCTAAGGCAGGGCATCTCCGCAGGGCTGAGTTTGCCTCCCAGGGGACAGTGG
CAAGGTCTGGAGACATTTTTGTTGTCCCTTCTCCGCTGGGGTTTCTATTGAACATCCCACGAAGCCCTCC
CAGTGAAGATGTATCTGGCCCCGCAAGCCAGTGTTCTAAGTCCTGAAGCCCCGTCTTATTCTGTAGGTTG
AAACCACTGGGCTGAGGTGGATGGGAAAGTATTTGCAATTTTCCCCCAAGGGACAATCCCCGGCTGCTG
GAGGGAGGCTTTGTGTTAACTCTTGCTCCCTTCGCTTCTTTGTCCCTTCCTGTCTTCTGCCCCCTCAGCC
TTTTATTTTCCCCTCAACAGACTTCATTCGGGGCCAAAATGGTTTCTGGTCTTACTTGGGGAATACCCT
TGGGCAAGGCAAGCAGTGAGAACAGGAACTCCAAGAAGGCCAAGTGCTTCTTACCTTGGTCACACCAGTG
GTCCACATTGGGGTCCTGGAAGAACTCAGGTGATGAGCCTGGGAGGTGCAAAGAGAACATTGGAGGGGGG
TGGGCAGAAGAGAGAGAGTGTGACAAGCACACTAGGGATAGAAAGAAGGAGAGGGTTCCAGGTGACCCAG
GCAAGCCCTCCTCTCTTTCCCACTGCCTGCCCCCATTTCTCGTCTCCCCCCTCACCTACACGCCTTTCCC
TCTCTGCATCTCAGCCACTATCCTCGTCCTCTCTCCACGCCAATAGGGGCAGCAGAGAGCAGAATGC
TGAACCTACAGGTGACAAACTCAATCTCTGAGCCATCCCCTCTCCTAGACTCCAGGGAGCCCTGCAGCTT
CCATCCCAGCAGGTTGGCTCTCTGAGACCTTCCTCTTCCACCAGTGTCTCTCCTCACCGTCAGAGCCCCA
GAGGTGGCTCCCCAGCTCCGTGCACCACACATCCCACAGCAACCTGACTCATGAATTGTGTCTGGCTTCC
GGACTCATCTGATACTGACTTTCTGTATGGTTTCTCAACCTTTCCAATGAGGATATTTTGCCTCTTCAAG
TTGGCCACCCATTCCTTGAGGCAGAAGGTTTGCTCTGCCCCTGCTGTTTCCCCCAGGCCCCAGAACAGAG
CCAGTCAGGGTCTGTGTTCAGTTCAGTTCTGTTGATGGATGGAGAGAGTGCTGTTATCTGCTCCTTCCCA
CAGCACCCCCTCTGAAGGATCTTTATATGTTATCTCACAGCATTCTCACTCCAGCCATTGTAGCCGATGT
CATTCCCCTGATTTTATAGATGCACAAACTGAGGCTCAAAGGGATTAGACATCTCTGCCAAGTTCTAAAG
GCTCTGACATAGTAGACTCGGAAATCTACTAAAAGCCACGCTTCTGCCCCAGCCCCAGACAGTCCTGAGA
TTCCTACAGTAGATAATGAGTCCATCTTCCATGAGCAAAGCCCTCTCTTTATGGATTGAGTTTAAATTGT
TTTGATTTCAGTTTATGTATGTATTCATCCCATAAATGCTTACATACTTCTACCCCGTGCCAGGCACTGT
TGGAACCTGGGAAGACACAGATGGATGAGATACAGGTGCTGCCCTTGAGGAAGAAGAGGCAGATGTGAGC
AGAGAGCTCAACAGCAGGCAGAGATGGGCAGAGCAAGAAAGGAGTGTGATGGGGAGGTGACAGGGCTTGG
CCAAGAAAGGCTTTGCAGATGAGATGGTGTTTGAGCAGAGTCCTGAGAGGCACGAGGAGGTGTGTGAGC
TGGGATCAGCTGGAGGTATGAGGTTCCAGGCCGATGCTGCCAATAGGACATGGAGTTTAAGGCGTGGGGT
GAGCATGGGGAGAGGTAGGGCTGGAAATGTGGGTTGGGGCCAGTTCACCCTGTGACAACAGGAAACCAC
TCAGGGCACTGGAATGAGAGAAGGATGCAATTGCTTTGTTGTTTAAGAGGCACCCCCTCGAAGGGGTG
CCAAGGGCAGGCTGAAGGTCCCTGTGAGTTGGGAAGATCAGCAGCAGCGCAGTGGGGTTAAGGGAGCTGC
AGCACTGACTGGAAAGAGGAGCCATCGATAGAGAAGGCAGTGATGGCGTGTTGGTGGGTAGGGAAGAAGT
TGAGATCACTTGTGTCTTTCCGGCTATGTTGTAGGCTGTCAAGGCTGCTGGTTGGGTTTTAGAGGCAGA
TTTGGGGAAAGCTTTATGTGTTCCCTTTGGGGGTGTGTTGGGTTTGAGACACCTGAGTTATCTGATAT
ATTTGATTCAAAGTTAGGATTGGAGGCTCATAAAAGATTTATGAGCCATCAGCCTAAACGCCCCTTAGCA
AGGTTGTCGCTGAAGTCAGGGAGGGCATGAGGTTTCTACTCCTTGGGGAGACATGTGGCCATTTCCATTA
ATCTATGCCTTTGTGTGGAATAATAGGGCATCATCTTTGTCCCTAAACTAAACTTTGTGCCTTAACTTCA
GTAGCCCAGAGTTGGAAGATTCAAGTATGTGATGAATAAGTGATTTTTATCCTTTCTGTACCACTAAGAG
TTCACGAATATCTGCAGCATCTGCATTCAGGCTTCCCCTTTCCAGGGGCGCACCTGATTTTTAGATGTTA
TAGTCTTAGGGAAGGCTCCTCTCCCTTTGACATGTCAGCTGCCTGTCTCCCTCTGGACCTGCCATTGGCT
TTTTGGAGTAGTCAGCTTTCATAGAGCATTCCAGGTGTGGAGCTCATGCTTAGTACAAGGTCAGATGTT
CTTTCTGTTGCGTTGAAATCCCTTCCTGCTGAGGACAGACTGGCCTTTCTGTACTGAGGTCTTGGAGAA
TGGCTTTATGACTCCAAATCTCTTCCAGGCTTGTATCTGATTGCTCAAAGATATCGCGTCTAGTTTGAA
TTGTTTTTTTAGGAACTTACCTTGACCAATGACGTTAGGAAATTAGATCCTCAAATCAAAAACCACAAA
TCCTGCAAAAAGAACTTACCAGCTTCAAACTTTTCACACTGCTCTTTTCATATATGCATTTGCTGTCACC

-continued

Sequences

```
TCCTTGAAAGGAAAGGGAAATTGAGATCTCTGACAGTTAAATTGAAAGATAAGTGGAAGGGAATCACAAT
TACTGAATGCCAGTCCCTGTGCTGAATGCTTCACAGAAGTCATTTATTCTGATGACAGCTCTAGAACTAG
AGTTTCAGTTTCCACAAATTATGAATTAAGACACAGAGGCTCAGAGACGTGGAAGACCTCATCTACCACG
TGGTAGGTTTAAGGATTCCAGGGAAAGGAGAACAACTAACTCATCCAGCCCACCGACACAGCTGGGAATG
TGCACGGTTTTTAGGTTCAAGCCCAGATCTGTCTTTTTCTACAATTTGTGCTCTGTCTTCTTCATCAAGC
TGCCTTCTGGAGGGGAGGAAAGTGGAACAACAGAAGCAGAGGCCAAGTGAAATAGTTTCTCAGGTGACAG
AGAGTGGGCAGGCAGCAGATCTTAGTGCAGGCAAATCAGACACCAATTCAGAGGTGACGTTACATGGGTA
TGCTCACCTCCTATATCCGCTGCTGAAGGAGCCGTGCTCAAATACGTGGTAGAAAATACTGAAATTGAAG
ACATGATGAGGCATTATCCTGACTACCCACCATCCTGATATACTGGGGGGATCTTACAGCCTCAGCTAAA
CCCATGTGATTACATATTCCAATAAGGAGCCTCTACGCTAGTTGATGCTGCAGGAGGCACACCAGTTATT
ATCTTTTTGCCTCCTGGGAATATTCACTTTATTACTATATAGTAAGAACATTTAGGAGTAGCACTCTCTA
GATGAGCTGGTTGGTTAGGTTGACAAAAGCCCATGCACAAATGCTAGAAGTTTAAGGAGAAGGTTCAGTC
ACCACAATCTCTTCTGCCCTCACTTGATTTGACAGTAAAAGCTCAGGCCTTTGGACTAACTTTGGGGGAA
ATTTTGACCAATTAATTTTAAAATAATCCTTAATTTTTGAATTTCTTGAAAGAGGTATGTTTTAAATTT
TCAAGTAGCTAGAATTGGGCACACAAAGTGTTGCCAAGAGGCAGCTCTGCTTAGCAAATAGTGACCACAT
CAAAACACCAGGCTCGGTCTGGTGTGTTGTGTTCCTGCGCCCATAACAGTTACATCTCTTTGGTGTCAAA
TGCATGTTTTTAAAAATCTTGAACACTGTTTTCTCTTGGCTAAATAAACAAACTCCTTGATGGCTATTTA
TAACTGTTTGTTAAGGTGTCTCTCATAAGCTCTGCAAAGTGGTTAGAGCCCAAAAGGTATGTTTTGCAGG
TTGGCTGTTGAGTAAAGACCATCTGTTTAGATCAGCGCCTCAGTATCTCCTACCCAAGGCCCCTGCTTAA
AGTTCTGAACTAGTATTTCTCGGCTTGTCAAAGCTAAGCTGCCAGCTTTTGTGGATGATACTGACTGTCT
TCCTCCTGGGTAGGAGCCTGGCCTCGCAAATTCGCCCGTGAGCCCATTTCACCCTGTTTTCTAGCTCATT
TACCCCAGGGCTCCCTGCAACCTCTGAAAACCTTCATATCACAGAGAGCCAGTGTTTGAGGGGCATTTGG
TTTCAACTTGCTTGTGTTTGAACGTTTATATTTATAATCGTGCTAATCTCTAAGGCACTCAAATCACGTT
AAGAGCTTTGTCCAAGGCTGCCAAGGAAATTAGCATGTATCCACATGACTGGGAAGGATGGAGAAAGTGGG
TAGGGCCTACAGAAAGGTAAGAGGCTCTGATGTTCCTTTCAGTAATCTTTTCCATGGGATTTTGTTTGGA
AAGCCATGCAGCCAGGCCATCCCCCTGTCTACCTCTCCCCCTCCTCCTCCCCCTCCCCCTCCAGCTGTGC
TCTTACTCTCAGCCCAGCCCCTCTCTCGCTATGGGCCACCCTGATGGTCCTTCTCCGAACCCTGCTGTGT
CTGTGCCACACCTTCTGCCACTTAGGGCCTTCCTTCTTATATCGCCCCTCCTGGCTTCCCACATATTTG
TCTCCAACCAAAGGGAGAGGAACAGGTGTGATTCTCTCTTGGGTCCCCCCCAGAACTGAGGTTGTGCTGT
CACAGAGTTGATGCCCCGTAAATAATGCAGGATGGATGGTTAGTCAGGTGGGGGTGGGAATGGGTATGGT
GGGTGGGAGGGAAGACACAGGGGGAAGGAGCTTAGATTACAGCAGACAGTGTAGGTGTGGGGAAGGGAAT
TTTGGGGGGAAGTCTGAACAGATTAATTTGACCCATCTATTAGGCTAATTTAGAGAAGAGTACAAGAGGG
AAAATTCCCTTTGAGCAATTAGAGAGGCGAAAGAGAAGCAGGGAATGTCCCTGATTGCATTACAGAGGAG
GAAACCAAGACGACTTCTTCTCAAGTGCTTTGCTGAAGCCACCATGAGAGCTCAGTGCAGTCAGGATGAA
AGAGGCCCATTTGCCTTCTCGGGGAGACATGGCTTTGGATTCTTTGAAGAGCAGTGTTGCCTGTCAAAT
TAGAGGGTTATGACAGGAGCCGCCAAGTGGAGGTTGGAGAATTCATCTCGCAACCCGGATAAC
TCCTACCTTAGCAGCAGATTTTATGTTGCCCTCCAATGTAAAATCTAGAACTTTTACTGCCGGAAGTTCT
CCAATACGTGTTCACTAGGCTTCAGCGTTTTTAGGAATCCCACCTAAATCTATGTCTTTATCTCCATGTG
GAGATGGTTGGTGTATCAGACTAAAGCAGCTCACTAGAAGGCTGAACAGAGTCTGGTTCTAGAATTTGTG
CCTAGCGCCGGGGGTTCAGGAAAGGCTCGGTAACGATGGTTTCACAGCATAGGGAAACTGTGTCTTGAGA
GAAGATTGATGGGAGCAAGGACAAATGCTAGGAGAAAGCGAAAGGATGGCAAATTAAGAGGGATGAAAAG
AAATGGCACATTAAGGTGGGAAATTAAGAGGAAGGGAAAAAAGAGTAGATATACATAGCAATAAAAGAAG
AAAAATCATTGTGATGCATGATGGATAGAGAAGTGACTTTCCTGTTTTTCTCTGGGCCCTAATGGACCCA
CCACTACTGATCGAAGGTAAGAGCAGACTGTTTTCTGTGAGATCCACTCTTAACGAAGAAGAGACCCCTT
AGCAGTCTTTCTCAGACCTCCCATTTCTTTCATTTTCAGGCTGACTGCAAGCCCATTTAGCTGGGAGTCC
TCTGGACAAAGGAAGCTTATCTCCCCGAATCTCAAAACCTATGTCAAGAGAACCTTTACTGAAGAGAGCC
ATAGAGTTAAACACTGTACTTAATTCCAACCAAAAACTAGATAAAGGGTTAGAAATCAGTGTTATTAGTG
GCCTCTCCTTCCTTCCTTAACTGCTAACCCTCAGCCAGGCCACTATAATAACAGTGTTATTTTTCATGCC
TGAAACGAAAATCAGAGATTCCATCAAGAAAGGGCTTTTAAAGGGAGGCTGTGTTATTGCAGTATTATTT
GGACTCTCCACTCTAAATATACAAATGATTCCAATTTCTCTTAATATGGGTTGAGGGTGGCGGAATTTAAG
TCTCACTGGGTTAAAATAGCAACTCAAAAACACACGTCAAAACCCCTAATGTCAGCCAACATTTATGATA
TAAATGAGCTTAGGTTTTTTTCTCTCATAATTTTAACTTTTTCAAAGAGATGGAGCTTTTATAAATAAGC
AAGCATGGCCATATTCAGCCTACGACATCTTGGCTCTGTGCAAGCCCATTTAGCTGGGAGTCGTAACTTC
ATTTCAGGGAAGATGTGTGAGAGGGTGGACAGGCGAGAAGTTTTATGTCAGAATTCTGGGTTTGAGTCCT
GGTTCCATCATTGATTAACCACGTGTCCTTGGAAGAGTTAGGTAACTCTTGGTTAATTCTTGGTCATCAG
GAATGTGGGGTGACAAGAGTCATGACTTATCTATGGGTTGTTGGGAGGATCGAACCAATTGATAGATAA
GGAAGAACTTGATCAACTGCCCTGCAAATATTCATTTTCACTTTTAATAGGTACCTTTATATTAAAAGGA
AAGAGGCAGGATTTCATCCTCAATGTGCATTCACTCTTTATTTAATAATGCTTTTGGTGTCCTACTGTGT
TCCAGCCAGCAAACCAGCGACCAGAGGACTGCCACTTCCTAGTGTCACATTGTGATGGTGTGAGGTTTAT
TCCTTATCCATTGCCAAATGATAATTTTTGGCCCTCAGAAATAAGGAGAAAAGCCCAAAAGCCAGAAAGA
TAAAGGATTAAGTTACTCTTTAAAATAATAAATCTATCTGTGTATTCTCTTCTCCTTTATATGGTGCGG
TAATTTTTAAAATTAGATTTTCCTCTGGGCCTTTCATCCTAAAAATGATGAAGTTCCCTGTCCCTGGTAA
TTGCATTTCTTTTGATTTTCTTTTATTATGACTTGCATATCACTGACACTTTTCCCCTGGAATGTTAAAA
GTATACATCATCCAGCTAAAAGGGGAAAGAAAATACTGTCTTAATAAAAACGGCAAAGAGAGAGAAAGTG
GAGATTCTGCTCCTTTGGTTCCAAACAAGGCAAAGTCTTCATTCCTTGTTCTTCATACATGCCAAGGTTG
ATGTCATGGAACCAAACCAGTTTGAGTTATCTGAAATAGAAAAAAAAAAAAAAAAAAAAAAAAAAAAAAA
AAAGGCAGTTCAACAATCGTGCGGATTGAAAAACAAATTTTCTACAGCATGATAACCTGAGAATAACTGA
ATACATTTTCTCTGTAATTTCTTGGGTCGGGAGTGGAGGGTGGGAGGCATTCTGGGAAAGACTGAAGGA
AGAGATGTTCAGTTCAAGGGGTGCTCTGAGAGATCCCAGAAGAGCTGGAGGGGCCAGAAAGGAATAACAC
GGTAACCTTGATTACCCTATGGTTCTACTATTCACAGAAAAGAGATTAAAAAAAAAAACAAAACAAAACA
CATGGTTGATGTATGAATACATCATCAAAAGTTACCATTAATGAGTGTTATTTATGAATGATAAGCAGGA
CACATCCAGGGAAAGCGGCTCTTATTTTTTCACAAAACCATTCTCACATTATTGAGATACATCTTTCATT
CCATTAGAACTATAGTCCTAATAGCTATTGCATGGCGTCCTACGCAGGAGTGGATAGTTGGAACTTTGGG
AACCCTGCCTGTCAGTCTCATGTCTAGGGCCTTGAAGGTTTGGCCATTAGTTTCTGTTGTGCCTAGAATG
TCAGGTGTATTCTTAGCGGCTCTATTAATAAGGCCAATTGCTACTAGTTTCCTCCAGTAAAACCAGCTCT
AGGATTCGGGCCTCCATTGCACCCAGAATAGATGGAATGGCAACTCTAGGACTTTTGATGAGAAACAAGA
AGGCCCTAGTGGACTGTTTCTCCCAGTCTCCCAATCATGTAAACCTTTTCCTTCTTTCTTATAATGCACA
```

Sequences

```
AACACAAAGTAGAATCCCAAGATCTTCAAGTTAATGAAACTTAGAACCCGAAAGGACCCTCCGAGGACAG
GTGGGGCCTTTCTCTTCCTGTCAAAAGTGAAGCCTTTGAAACTTGGAGAGGTGATTCCTTTGATGGCAGG
GAGAGGCCCTAAGCCTGGGGTAGTGGCAGCATGATGGGCTTCTGAGCCGAGGCATAGCTCTGCTCAGACA
CCTGCCTTGGAATTTCTTACTTTTTCATTAAAGGTCTGAAAGACTGGATGGCAGTGAGATTTTATATTTT
TAATTGATATGGTTGACATAAAATGTTATAATCATTTCTGGTGTCCAACAGTGCTTCAATATATGTATAT
TTTGCAAGTAAATCACCAAGGAACTCCCTGGTGGGTCAGTGGGTTAAGGATCCAGTGTTGTCACTGCTGT
GGCTCAGGTCACTACTCTGACGTGTGTTGAATCCCTGGTCCAGGATCTTCCGCATGCTGTGGGTGCAGCA
AAAAAACAAAAAAAAAAAAACGCCACAATGTCTATTAATGTATCCGGAATTCCTGCCGTGGCACTATGT
GTTAATGATCCAGCAGCTGGGCACAGCGGGTTAAGGATCCAGTGTTGCTGAAGCTGTGGCATAGTTCGCA
TCTCCGGCTCAGATTCAATCCCTGGCACAGGAACTTCCATATGCCAGGGTGCAACCAAAAAGAAAAAAA
AAAAAAATACATCCATCACCACACATAGTTATCGTTTTTTTTTTTTCTTTTTCTAGTGATGAGAACGTTT
AAGAACTACTGTTTTAACAATGTTCAAATATGCAATACAGTATTATTAGTCACCGTGCTGGATATTATAT
CCCAGGACTTATTTTATATCTGGAAGTTTGTAGAAAAAGTCTTATAAGACATGATGCGGTAAATTATAA
TTTTTAACATTTAAAATGACCCTTAATAAAATGACCTTTTCCAACTGATGTACCAAGTAGTAAAACTTAC
CTATTTGAATCTGTAATCATCAGTCATGATCTTACACCCGGGATCAGAAACCCTCCAGGTACGGGTGGAA
TAATCCTTTTTTTTTTTTTTCAGTTTTGGGGGTTGTTTTAGTGGGTTAGGATTACCTCAAAAGACATTT
AAATGATGTTTCAGGTTCAAACGGAAATGAAGAGCACATAAAATTGTAAGACGTAAGAATCTCAAGAATG
TGGCAGAGTTGAAAATGCACCAAGAAAACACGCTATTAGAGGTGTTTGGTCTGCCCATTTATCCAACACG
AATCCCTTCCCATCACCACCCTGCCAGTATTTAACCCTGCAAGGGTTAACAGAGGACTGTAGAGCCAGCA
GCTGGCTCAGACCCCAGCCAGGATGGAGCACCTGGCCCTCTGGGGCTGCCAATGGTCCAATGGTCGTGACA
CTTCACCATCTCCTGCAAGTCTCAGGTCCACTCGGGCCCAGGACCAGGGTTGTTTCACCAGGAAGAGGGC
CAGAGGGGCACACACAGCCCTTCCCATGGCTGCAGAGACCTCCCTTGTTCCAAGTAGCCCACAAGCAGCC
CTCTACACATCCCACATCCGAGAGGGTGCGAGGTCACTGTCTCCCAGGAAACTCAGAGCAGGCCTGTTCC
GGGAGCAGCCAGACAAAGGGACACGAGGAACAAAAACATTTGGAACTAAGGGATGAACTTCAGCTGATAC
AACACGAGAACAGGAAAGCAATGCCAAAGACCAGGGCCAAGGAGAAAAACAGAAAGGGAATTTCGGGGGA
AAGGGCTCTGGGGTAGAAGAGAGGTGTCCTATTGGGGTTCCGTGGAGTCAGGCAGCCAGGTGGTGAGGCT
CGGAGGATCACCCAGGCCCTGAATCTCTTCCGAATCCCCCCATCAACACACCCAGCAGGGTGTCAGGCCC
TCTCTGCTCTGAGTGGGCTGAGTTCAGAGCCACCTCGGGCACGAGCAATGCCGCCCTCACTTGTTCATCT
GTAGTTGGATGTGTTAGACCCCTTGCCCTGAACATGCTCTCTCTCAGCTGCCACTCCTGAAAAGGTTAAA
AAAACAAAACAAAACAAAAAGCCCTTCGTCGAAGCTTGGCCTGGCCGGGGCAGTCTCAAACTCACCC
CCAAAACTTCCAACCTTTCAGAAACAAACCAAACATTAAAGGATTAAACACCCCGGCAAGAAGATAGGTT
TTGTAAAAAGCTCCGTGGGCAGGTTCCTAGGAATTGAAAGGTCTCTGGCTTTGTTAAGTTATGAAAGATG
TCCAAGTTGAAGTCAGCAGAGAAAACTGTTACTAGTCATGAGACAGTGGGTGACGTCTGGATCACACGTG
GGCTCTCAGGCCGGGCCTGGCCGGGGTGGCTGGGCCGCCGGCCTCCCGCTCTGCCCTGAGGTGGGGCTG
CTGCGGACACAATTTAATTCAGCCTGGATCCTTGAACAGGGCCCTTGGGAGGGTCAGCACCCCCTCGCCC
GTGGAGGCTTTAGAGTCCCCTGCCTTAATATCCTAAAGAGGCCTCAAACTGGATTAGTTTTGGGGATGTG
AGGCAATGTTCTCCTTGATGTCCCAGAAGTCCTGGTGAGGCAGCCCTGGGAGTAGGAGGGCTCTTTCGGA
TACTGTGGAAAGAATTCCTCCTTGGGGATTCACTCCTCCATCCACACATCTTTTTTTTTTTTTTTTTT
TTTTTTTTTTTGTCTTTTAGGGCCGCACCCACAGCATATAGAAGTTCCCAGGCTAGGGGTCGAATAGG
AGCTACAGCTGCTGGCCACAGCCACAGCCACAGCAACGCCAGATCTGAGCCGCATCTTCGATCTACACCA
CAGCTCATGGCAACGCCGGATCCTTAACCCACTGATTGAGGCCAGGGATCGAACCTGTGTCCTCATGGAT
ACTAGTTGGGGTCATTACCGCTGAGCCATAACAGGAACTCCCACACATCATTTTTAAATACTCCTGGGGT
GACGTGTGCAAGAGCAGCCACCAGGGCCAAACCAGAAAGTGAGGGATGCCAGGAAGCACGTATTCCCGGG
GGAGCCAGACTGTAGAGCCACCGGGAGCTGCCAGGGCTAGTGGGGGATTGGGATGTGTGCTTTCTCCCTG
GTCACGGGGACTTCTTCAGTGAATGCAGCCCTGCTCCCTCCGCTCACCCCGCACCTGCACACAAGTC
TACCTGCACTGGAGGCCATAATCCCGACCTGAAGCCCGTGCCCTGAACACTGGCTGCTCTTTTCCTCCC
TTATGCAGAGTTCTTCAGGCTCGGCTCCTAGCTAACCTCGGCCCCTCTAGCCCATCTCAAAGACTCTTAA
TGCATTTTTCAAGTCCTCCCCATCACCCATCAGAACTTTCTATTGAACTTCTCATATTTACTGCTTGTCT
CCTCAAAGCCAGCATCTTCTTCTTTTCTATCTCCAGCAGGAGAAGCAATGTGAGTTGAAAAAGCCCAGAC
CTAAGAGTCTCATAGTTCAAACTACAGCCATGCCACAACAAGCTGTGTGATCTTGAGCAAATTGTATAAC
CTCTCTGACCCGTTTCACCTGTGTAATGTTGTTTATAAGAGCCACCTCATGGGCTTGGTACAATGGCTAC
TTCTTCTTCATCCCAGAAGTAGGCATGAAATAAAAAAACCTGGATAAGTGGTTTGACTGTGGTTGCTTTC
TGGCCTCAGTCATGTCCAAAGGAGAGAGCAAAGCAGGAGGAGAATAGGGATGACACTTGTGAAAAGGTGCCA
TGCAGTGCTAGCCAGAGCCATATAGTGTTTGCAGCAATTTTACTGTGAAAAGCATGTGGCACATGGATCC
AAGATTTATGCATTTGGCCGAGGGACTACCTGGTTGGAAATAATCTTCGAGACCCAGAGTCCCACCTGGA
GGCTTCGTCAGCCCAAACTTGAACTTCTCCTTATGACCTTAGGGAAGAACACTATTTGCATCCAATGGGA
CACTGCTGTCTCCGAGTCATCCCGCTGGGAGAGGGTTTGCTGAGTCCCCTCTTTGGGTAAGGAGGAGCTG
ATTGTATTGGGTGGGAGGAGCTGATTGTCACACAGATGCCAGGTCCCCTGCGCCCCTGCAGTGCTGAGCA
TAGTGCTGGCACAGAGCAGGTGTTAGGTGCAAGCCTGCATCTTGCAGTTCAGCTGCCCGTTCCATGGC
TTCAGCGGTGGCAGGAGATGTGAGGCCCACCACGTGCAGGCATTGACCTCTGACCTGCCAGGGCCGCTTG
CAAAGTTCTGGGCTGGAAGGAACTGGTGGAGTTTGGCCCAGGGTGTGGTTCAGAGCCCATCCTGGGCCCA
GCCAGCAGATGCCTGCGCCCTTCGCAGGCAGGTCCCGCAGGCTCGATGCTGCCAGCCTCAGACATGTCT
GAGCATGTGATGAGGGGTGGCCGGTGGCCTTGGAAGACGAGCTCCATGGGCACGGCCTCTCCCTCTCAGT
GCCCACAGCTAACGACACTGACAGTCCTTGTTCAGGGTGTACACGTCCTATTCCCACCTTGCCGGTGTCC
ACGGTGGGCTCGCCTCACTTCAGGAGGGTGACCTGGTGTGGGATCAGCTGTCCCCCTGCTGTGCTGATGG
AAAAGTTTCAGCCCCTCCTCTCACTTGAAGCCCATCCAAGATGACTTTCGGATCTCTCTCTGTGTCCCTC
TCTTTCTTTCCCTGTGAGTCTCTCTCCATCTCTCTGTCTCTCTTTCTCTGTAACTTTGTCTCTTCTCTTT
GTGACTTTGTTTCCCTCTTTTTTTGTTTCTGTCTCCTGTCTCTTTGTCTCTCCCTGTGAGTCTCTGTCTC
TGCCTCTCTCTGTCTGCCTCCTTCCCTCTGTCTATCTCTGTCCATCCCTGGCTCTCTCTCTTTCTCTGCC
TCTGTCTCTGTTTGTGTATAAGGCCCTGAACTGTCTGGCCACAGAGAGCACCCACTGTCACAAGTCCTCC
ACAGTAAACATCTATTAAATGAGTGGCTACGCCAGCATATGTGCCTGCATTAATGACCCTAAATTC
AGAACCACAGCGCTGACCTTGCCGGGGTATGCACGTCCCCACCCTCACAGCTGTGGCCGCAGAGGAGACT
CTGCATTTTCTTGTGATGGAGAGGTCTGCTCTCTTCCCTGGACACAGGAAGACTGATGCGGAAGGAAGAG
GGTTGTCAAAGAGCCAGGCAGTGTGCCTTGAAATGCATCTGTTTTTATTCATGTTGAGTCTTTGCAGGTG
AGCTGAACTAAATCATAAACTACAAAATGAAAGCAGATTTTCCCTAGCACTCCCATATGGAGCCCACTGA
GCTGTTTGTTCACCACCATGGCCGCCCCTCTTCCCCGAGCATCTGGGGCCTGCTTGCTCTTCTTTTACTG
AGAGGCAGACAGGTCTGTGGGGTGCGGGAGAGGCTTCCCCCGTGAGCTGCTCTGCTTGAAGGATCCCCTT
```

-continued

| Sequences |
|---|
| GTCATTCTGACCATCATTCAGTGACTTACAGGGCTGCAGAACTAGGGCACAGGGACCAGGGTACAGCCTG |
| TTATCTCCCAGGGTGCTTTTCAACAGGGTGTTTGAATCCTGGAAGTTTTAAGCAGAGTTTTCGACTCACT |
| TGCTGCAGACTGAGAATGCCAGAACCAGCACCATGGGGAGGGGGTTTGGGGAGCTTGGTCCTGGTCCTG |
| GGCAGGTGTCTGATGGCTGATTTTTTTTTTTTTTTTTTTTTTTGCTTTTAGGGCCCCGCCCACAGC |
| ATATGGAATTTACCAGGCTAGGAGTCAAATCGGAGCTACAGCCACTGGCCTACACCACAGCCACAGCAAC |
| ACGGGACCCAAGCCACGTCTATGACCTACACCACAACTCATGGCAACACTGGATCCTTAACCCACTGAGT |
| GAGGACAGGGATCGAACCTCAGTCCTCATGGACACTAGTCAGGTTCATTATGGCTGAGCCACAATGGAAC |
| TCCTGATGTCTGATTCTAACATCAAGGCAAGGGCCCTGGAGTCAGTGCAGTGGTGGAGCTTCAAGAAAAG |
| ACACCCATGATGGTTTCTTTTCTTTTCTTTTTTACCCACAGCATATGGAAGTTCCTGGGCCAGGGATTGA |
| ATCTGAGCTTCAGCTGCCATCAACACCACAACTGTGGTAATGAAGGATCCTTTAACCCACTTTGCTGGGC |
| CAGGGACTGAACCCATGCTTCCACAGTGACCCAGTCCACTGCCATCAGATTCTTAACCCACTGTACCACA |
| GTGGGAACTCCCACATGCTGAGTTCTTAACCAGTCCTGAAAGCAAGTGTCAGGGCAGGCCTGGCTGAAGC |
| TGGCGGGCTCTGCCCTGCTAAGGATGGCACCCATGCAACTCATTCCCTTTTGCACTTTTCACTCTGACAC |
| ATCTGCTTCAGATCCAAGGCCACTTTCCGAAAGTTCCTATTAGGAAATGCGGGTCCTTTGTACTTTGCGC |
| CACCACCAACTTCAGTCAACACTTGCTGATTTAAACAAGTGAGAATCAGACATTCAGCCCCCAACTCTGG |
| GCCTCCACATTTGATAAATGAAGGACCCCCTTTCACCCCCTGCCCCCCAGCAGCGGTGCCTGATGACGAC |
| ATTTAGGCCAAGCGCAGGACTCAGCAGCATCTGCTTTCAGTTCCCATTCTTGGCATATTTTCATGAATTA |
| ATTCTTGCAGCACCAAAGAGCAGGAGCGGGTAGGTACCCTGGCTGTGCTCTGCATTCACAGGCCACATGG |
| CAGGCACAGCAGAGCACTGCAGGCTCAGTCCAGACAGCGACCCACAGGGGGCGCACGCACCTGCCACCAA |
| GGGCACAGTGATCAGGTTCATGCTCACTTACAGGCAGGTCTGGACACTGGCCAGGGGGCCACACTTGTGA |
| GCATGGGTTGAGAACAAGTGAGTCCTTCTGTTAAATTCCATGTGGCATAGTTCAGTCCACTTCTTTATGT |
| AGTGTAAAAGTATAATTTGTTGTTGTTGTTGTTGTTGCTGTTGTTGTTGTTGCIATTTCTTGG |
| GCCGCTCCCGCGGCATATGGAGGTTCCCAGGCTAGGGGTTGAATCGGAGCTGTAGCCACCGGCCTTCGCC |
| AGAGCCACAGCAACGCGGGATCCGAGCCGCGTCTGCAACCTACACCAGCTCACGGCAACGCCGGATCG |
| TTAACCCACTGAGCAAGGGCAGGGACGGAACCCGCAACCTCATGGTTCCTAGTCGGATTCGTTAACCACT |
| GCGCCACTACGGGAACTCCAAAAGTATAATATTTTTAAGAAAAATTGATGTACCTTAAAATTCAAAGTGA |
| TTGGTTTATTGGTTTTTAGTATTTTTATTCAAATGGTAGTGCAACCATCACTGTTCTCTAGTTCTAGAAT |
| TTTTTTGATCACTCTGAAACCAAAAAAAGTCCCATACCCTTTAGCAGTCTCTTTCTGTTCTCTCTCCCCA |
| ACCCCCTCGAAATCCCTAATCTACTTCGGTCCCTATACATTTATCTATTTTGGACATTTCATAGCAATGG |
| TATCATACAATATGTGACAACTTATGCCTGGCTTCTTTCACTCAGCATAATATTTTCAAGATTCATCCAT |
| GTTGTAGTTGGTGTCAGTGCTTCATTTCTTTCTGTGGCTGAATAATCTTCCATTGTGTGGATGGTATCCC |
| CTTTTGTTTATCTCTTCATGAGCTGATAGACAGGTGGGTCATTTCCCCTTTGGGCTGTTACGGATAATGC |
| TGATGTGACTATTTGTGTATCAGTTTTTGGGTGGACATACATTTTCAGTTACCTTGGGAATATATCTAGG |
| AGCGGAATTGCTGGGTCACTCTTGGGGTTCAGCTCTTTGAGGAACCACCACTGTTTTCCACAGAGGCTGT |
| ACTATTTTCTATTCCCACCAGCACTGTGTAGGGTCTCCAATTTCTCTTCCTCCTCATCAACTCTTGCTAT |
| TGTCCACTTTTTACTTTGTAGCCATGCTAGTGGGTGTAAAATGATATCTCATTGTGGTTCTGATTTGCAC |
| TTCCCTAATGACTGATGAGGCTGTCTTTTCTTGAGTTTATTGGCCATGTGTATATCTTCTTTGACGAAAC |
| GTCTATTCAAATCTTTGTCTGTTCTTTAATTGGACTATTTGTCTTTTTATTGTTGAGTCATAATAATTGC |
| ACTTTTTTTGCTCGATGTACATTCTTGACCAACAAAATATTGTAAAGTGATTATTCCCCCCCCCCAACGA |
| TGAAAATAGCCCAGGCTCAAAGCAAGAAAAGGCCAAGCGCCAGAAAATGCAGGATGCATTAGCCAAAAGA |
| AGGTAGTAGAATGAGGAAGGTCAGGAAGAAAAATGAAGTAACTTTGTTTTAAAGCCAAAACACTGCAAGG |
| CAGTTCACTGAGGCCTCTGTGCCTGTGAGGTCCCATAGAAGGCACTGTTCAAACAAGGACAGCGGCATTG |
| GCATCGGTGCCCGTGCTGCTCCCCAGAGCCCTGCAGGGTAAATGCATCTACACACATATACATACACAGT |
| GCCTGGAACATGCTGAGAGAACTCTCCTGCTGTCGAAAGCTGCAGCAAGTACACGAGAGGCTCACACCGC |
| AGTTCTGACAGCGCAGGCCTGCATAGTATTTTAGCTTTGAAACTCCTGTAGTATTTGCATAGCTAGTGCAA |
| GTTCCTGAATGAATCAGCAAGTCAAAGATGAGATTTCGAGGTCTCGTAGAGATCTGGCCTTTCTTCTGTG |
| TTGTTTTGGTTTATTGTAGGAACCTGATGAACCACATGGCACAATTATTTGTTTATTTTTTTAGCACAT |
| TTTGCTGTAGATGCATTGCTTTGCACCATTTCCACAGACGTCTTTTGAAGTTCTGGACTGTTCTCGCCTC |
| CTGGCAGGAGGGACCTAAGCTACAGGTGGCCAAGTCCCCACTCCCTGTAGTATTTGCATAGCTAGTGCAA |
| GGACTAAAGATCTGTCACTGAGCTTCCCTCGGGGTCGCAGCGCCCACCCCAGCCGGGGGGCGGGGGGCA |
| GTTAGACTAGCAGAACTGCCCAGATCCTGCCTGTGCTGGCTGCCTCTGGCTCAGGTCTCCTCCAGCAGGT |
| GGACAGGACCAGCGGCCTTTGACCTGGCTCAGTGGCCACAGGGTCCCCAGAGCAACAGACGCCTTTGCAA |
| ATTAGTTTCAAACTGCGGAGGAGAAAAGGAAGGAACCGTTGGGGTTCTCATTTTTCTGCCCTCCCAAGCT |
| CCAGAGGCCCACCCCCTCCCCACCTGATTTGCATCCTCAGCTCAATTTGCATCACAAAATACACCCAAAC |
| TTCCCTGGACCCGCTGCCGTAGGCGGGCAAGTTGTGTTTTTTGTTTTGTTTGGGTTTTTCATCTCCTGC |
| CATTTCTCTAGCAGGTTTCTGGTTACATCCAGATGACACTTAGATTAGGTTTCACTTTACGTCCCTTGGC |
| TGTGATTCAACTAGCCCCTCCTCCTGGGCCAGAGCCCCTGCAAGATCAAGCCCCATCCCCGGGCCATGGC |
| TTGGGAGGCAGCCCTGCAGGCCATCCTGCTTCTCACACTCACTCGCGCCTCTTCACGACCCGTAGGCCCT |
| GCAGCTGTGTGCCTTCAGCGAGACACTCCAGGGTTGGAGCCTTTTTTTTCTTTTTTTCTCTTTCCTTTT |
| CCCCCAAACCCGGAATCAATATTTTGGGAGTAAAGGTGGGGAAGGGAGGGGGGAGAAAGAGCCACAGGAG |
| ACAGAGGTTAGCAGTCACCCAAAGTGGCTCAGTTCTCCAGACAGAACCTCCAGACTCATTCAGCACAAA |
| GTGGCTGCAGAGGAAATCCTGCCGGGCCAATGATAAGGGGGGAAATGGAGTCACTTCCTTACCAGCTGCT |
| TTATTCAGGTAGGAAAAAAAAGTCCTCACTTCCTCGCGTGTGCTCCGCTGGCCACCACTCTTGGCGGCCC |
| AGCCGCCTGCTTCCCCTTTTGATCTCTGCCACGGCTGGTGTCCAGAGAGTCACTGCCTCCCGGGCTTCAG |
| GAGAGCCCTCTGTGTGTCCGCCTTCTCCCCTCCACTTCCTTTTTTCTCAATCTCTCCACACTCCCTCT |
| TCTCCCAGTGGTTGCACTGCAGTTGCTGTGTGCCGTTGGAGAAACCCTAGATAGTACTTATTGGGAATGA |
| GTGTCACACCCTTGCTGGAATCCAAGACTAGTGATCACTGGTGGTCCTTATGTTCCCATGAATGTCCAGG |
| AGCGGCTGGAGGCCTTTGATCACCTCTCCTGCCCTATACAACAGGGCACCACCGCTGCCTCTCTGGTCAA |
| TGCCTAAGCTTATTGCTTTGTATCTCCAGGCAGCAGTTCTCCGTCTTTATAACCCGGTAGGAATCTCCCT |
| GACAGAGGGATAAAGGGCCCGGTGAGTCTGAAAAATACCCCACAGCTTATCCCTCCCTTGGAGACTCAGA |
| GGGCGTATGGGTGGGCCTGCTGTTCAAAATGATTAACCACCAACATGGCACAGATGATGACCAGTCAGAT |
| CCAGCACTGACGGCCAAGAACTGGCTGAATGTCAGTTCCTCACCAGGAAGACAGTAGAGTCTGGGAAAAA |
| AAAAAAAAAAAAAAGGCATGGATTTGTTTAAGCCAATCATTTATTCCCTTTGGACAGACTTCTTTTAAAA |
| AATATCATCTATTGAAGTTCCCATTGTGGCACAGTGGATTAAGAATCCGACTGCAGCAGCTCAGGTTGCT |
| GCAGAGGCATGGGTTCAATTAATCCTGGCCTGGCACAGGAAGGTTAAAGGATCCAGTGTTGCCTCAGCTG |
| TAGCTTGGATTCATTCCCTAGCCCGGGAACTTCCATGTACTGTGGGAGCCATCATAAAATTAAAAGAAA |
| AAATCATGTATCATGGTGTGTTTGGAAGAACTATTTTATAGTAAAAGAAATCAGTGTATTTCAGTTCCAC |

| Sequences |
|---|
| AAACATTTGCTGAGTACCTAATAAGTGAGAGACACATGCTCCAAGGATCCAAAGACAAATAAACTATATG |
| GTCCTTGCACCTCCAGGTTCTAATAGATAAAGACAGACCTGTAAACAGATGATCTTCAGATAACACAGTG |
| AACAGGGACTAGCTGAGGATTATTTAGCTCAGCCCAGGGGCTAGGAAAAAGCTGCCTGCAGAACATGATT |
| GCACTGAAATTCCTGAATGAACCAAAATGGACTTATGAGCGACAGAACTGAGCAGGAAGCTAGGTTGAAG |
| GAGGGCATCTGGAGCCTAGGATGTCAAGAGTTTGGACTTAAGCATGGAGATAACAGACTTGATTCTGAAT |
| AGATCATTCTGGCTGCAACAGGGAGAGGAGATTGAAGGGTTGGGCGTGAGACTACAGGCAGAGAGCTCCA |
| ATGGGAAATCATAGCAGTGTCCTGGGCAGGGAAGGTAATGGGGCCAGAGACATATTTAACAACATAGGTG |
| GTCCATAGGCTGCTGTGTGGAATCCCCTTACCACTTCAGTGCCCTCTAGCTTGACCTCTAGCTACAAGAG |
| ATGCAGCATCTGGATCTCTTTCCCTAAGGGCTTTCTTTGGCCTCTAGAGCCCACTATGCCTGTGCACATG |
| ACTGCCTGAAAGTACTGAGGTATTTATGCTACCACAGAAGCAACACTCAGCCACTGAATGGAAGGAGTTG |
| GTGTATACATACCCCAGCTTCTTCACTTCTTAGTGGAATAACGGGAGATGCGTATTCTGTGCTGGGCTCC |
| GGGTTTCCCAGCAGGATTGAGTTCCAGTTGCCAGCAGCAGAGACTTGCTTGATAAGGTAACTCATGACCA |
| CATTCCCTTTTCCGTCTTACTTCCCACTCCCTTCTGGTGTTTCCTGGGATCACCTTCCACATAAACTGT |
| TCACACTCCAGTCTTTTCTTAGGGTCTGCCGCTGGGAGAACCCAACCTAAGACTGTGGGATTTACCAGT |
| GAGTGAATTGGATGGGGGTGAAGGGGGAGAATCTCTCTAGGAGATCTTTGGGCTGTGCGCTTACTTGACAG |
| TATGAATACGGTAGAGGCAGGAAGAGAGGCAGGCTTGCTGGAGGGGCTGTGATGGCCCCAGGTTGGACAG |
| GCTGCCCTGTAACTTCTGGTGGGACATCTAAGAAAGCGATTGGAACAGGAACCGGGCAGTCAGGGGAGCA |
| AGTGGGGCCATATGTAAAGGTTTCAGAGACGTCATCATAAGGATGGTGCTTGTGACCATGACTGTGAAGG |
| AGATTAGCTGAAGAGAGAAGACAATCCAGATGAAAGCTCAGGAGCATCAAGTACTTATCAGGGCAAAC |
| AGACAAGGTGCCCATGAAGGGACAGAGAAAAAAATTCTCCAGGAGGGAGCTCCCATTGTGGCTCAGCAG |
| GTTAAGAACCCAACTAGTAACCATGAGGATGCAGGTTCAATCTCTGGCCTTGCTCAGTGGGTTAAGGACC |
| CAGTGTTGCTGTGGCTGTGGTGTAGGTCAGCAGATGCAGCTCCAATTCAATCCCTAGACTGGAAATTTCC |
| ATACGCCAAGGGTAAGGCCTTAAAAAAAAAATACACACACACACACCCCTCCAGGAGGTAAACACTTA |
| CCTTGATCTCAGTGTCCAGCACATCAAAGCACCAATCACTATATGCATTGCAGAGCCTCCAGGGGATTTAG |
| CCACATGGACGGTATTGGTGGTCTCTAGGGGTTGGTTTCAGAAGCACAGTGGAGGAAGCAGCCAGGCCGA |
| GTGGATTAAAGTGTGGGTGGAAAGGCCACCGATGTAGGTGGGTGATCAGTTTATCTTGGAGGGCAAGGCA |
| GAGGAGATAACTTTCAGGATGGAACCCGGCATCGGTGTGGACATTCTGAGCAAATCTGAACATTCATAGG |
| CCAAGGAAAAAGACAGAAGGAGGATGAGGTTGACAATATAGTTGTGACAGGGATAATTGATGGAGGATG |
| AGTGGAACAAGTGTGCGGTGGAAAGGAGCGGGGAGGACAGACAGAGATGTGAGTTGATGGGGGCACCCAG |
| GTAGGAAGCTGCAGTAATTCCCGCCCAACAGCCCGATTTGCTCAAAGAAAGAGGTGACTGCTAAACAGTG |
| GAGGTAACACATGAGAAAAGAGTTGCTGTTTGGAATCGTCATGGAAAGAAACAGAGGCGAGATCCCGGGC |
| AAGGGAGTGCTGAGTGCCGAGTGCTTTCTAGAACTCTCTGAGTGTGGAGCCCATAAATTGAGAGACGGCC |
| CAGTCAACATGGTTGGGCAATCTTTGTCAGCAACACCTGGAGGCCAGAGGTGGCGGGGGTGGGGGGAGA |
| AATGGATCAAGGTCAGGGCACAGAGGAAGATTGGGATGGGAGGAAGCCAGTTGCAGGCAAGGAGGAGGAG |
| GGGCCTAGGGAGATAAAACCAAGTACTGGCTGGTATTCTAACCCCACCAGCCCGAGAGGCTGGAGACGAC |
| AGCCCAGCCCCATCCCTCTCCAGCTCCTCTAGGCTTATTAGTGTGTGCCGTGAGTAATTTACCTGTCTAC |
| ATTTCATTTCTCCCATCTATGTAAAAAGGCAATACTTTATTTTTTTGCTTTTTTATGGCCTCGGGTGTAG |
| CATATGGAAGTTTCCAGGCTAGGGGTCAAATTGGAGCTACAGCAATGCCAGAACCGAGCTGCATCTGAGA |
| CCTACGCCGTGGCTTGTGGGGACACCAGATCCTTAACCCACTGAGCAAGGCGAGGGATCGAATCCGCTTC |
| CTCATGGATATAGTCAGGATTCATTTACACTAAGCAATAGCGGGAACTCCTGAAAAGAGGGTGCTATCTT |
| TACTATATGGTGCAGGCAATCTGAACTTCCGTGGAAGTAACATCCAGCTCAGTTTTGCGTTACTATGGTT |
| TGCCTTTTTTGTTTTTATAAGGTTGTCACGAGGGAGGTGATCCCCATGGATCACTGATCTCTGTGTGCAC |
| CCCCGAGGCGGGACAGAGCCCTCACCAGTCCTGACACGAGCAGGGGCTGCTGTGCCTCCCAAATATATAG |
| ATTGGGATTTGGTCCGAGTCACGTGATGATGTCCCAGGTTTTCTTTTTCCCCCTTTGTTGCTTTTAATAC |
| ATAAAATGAGCATGTGTTTATTTAAAACAGCTTTCAAACTTAAACAAATAATGACAGACTGTTCAAACAG |
| ACTTCGGAAATCACCCTAATCAGGATGTTTGGAAAAGCGAGAAGACTCTCCATGAAAGTAGCTTTTAGGA |
| TCTTCATGCCTGAAACCACAGGGTCTGTTTTACACTTTAGAATCATAGATGGCAAACTGTAAAGGACAGA |
| TTCGATCTCAGGGCACACCTCGGCCCTACAACGTGACTTAATAATTTATGAGGAAGTAGAGTTGAGCGTG |
| TGTTATTGCTTCCAATCTTCCATCAAAGCACATCATGTATACATTTTAATTCATTTTAATTCCTATAGAAATC |
| ACCAAGGGAAGGAAGGCGGGGGGTGGGGGTGGGGGGAGGAAGAGAACACGGAAGGAAGGAAGGAAGAGA |
| CACCTTAGAGGGAGCTACTAAAGTGCTTCTGGAACTAGCAGGTTCTGTAGACCATCTGGAGGGAAGGGTG |
| GTTTAAGGAGGGATGTAGCAGGTTTGCAAGAGGACAGAACAGAGAGTGAGTTAATGCCTCCAATAGTTCA |
| CACTCCGGGCCACATTTACAAATGGCTTTGAGTCACCTACGTTTATCTTCACAACAACCAATTTTCTGGG |
| TGAAATAAATGAGGCTCAAGGAGGGGTAATTTGTTCAAGGTCATAAGCAATAAAATGTCAAAGCTGGGAT |
| TTCACACAGACCACCTCCCCCCAAGTTCAGAACTAGTCCCCAGACTCTTGGGGGCTGTGTCAGCGTCTCT |
| GTGCTCATTCTTTGGATTAAGAGATGCCACTTTAGCTCATCCCACTTTAGAGGTGAGTTTTTCCTTCCAG |
| TGCACATCAGAAGTGGGCCATTAGGTCCATTAGAAACACAGTTATTTACATGAGGGGCCAGAGCTTGGGA |
| GAGGGAATTAGTCCAGCCCAGAGAGGGGGAGGTATTTGGAGGGGTGTTTCTTCCCACTGGTACGTGCATC |
| AGGCAGAGCAGCCTGAGATTGCCCTTTCTTCCTGCACTTTTCCAGGGTGGCTCTTAGGCCAGAAAGGGCA |
| GAAGGCCAAGGCCTTAGTCTGTTTCCTATTCTGCCTCAGAAAACTCCATTAATAACCAAGGGGATACAGG |
| ATCCAACCACTGACCCTCTCAATGTCAAGCCAAACTGCATAAGGCCCAGGGCCAGCACTCCTAGGAATTT |
| GGGCCTCCTTTGGCTGGGCTATTAGGGGTTCCAGCCCGCCCATCCCTCAGAGAGAACAGCATGGAGGGGA |
| AGGGATGTTAGATGATTGCTGTATGTCCGTGTGATCCTGGGATGCACTTTGTAAGAGGCAGTTTCTCTAA |
| GTAGATCCTGATCCTTTCTGCCCCATTTATTCCACTTTTACAGAGAGAAGGTAGGTGTCTTGACAAACAA |
| TCATGATTATTAGTTCTGCTTTAAGGGCATTAAGCCCATACTTCATTTATGTCTATTGCCTTGCTTTGCA |
| CTAAGGCTCAAACTTGGAAAATTTAAGCAGGTTAAGAAAGAAAGCCCTTGCGCCCTCTCCTGGTAAAGTT |
| AACCCAGTACATCTGAAGGTAGAGCTCCTGCACTTGTTGGGGAGGGAGCAGTTACTTGTCCAGGCTAACT |
| TATCTTGTGCTGATTTAAGGAAAACTGTTGGCACACTAGATTGACCATTGGGTCTTCTATGGGCTGTGAT |
| CACAGAGTTTCTTCTAAACCTTTGTTCACAGGGTTTCTCAGCCTCAGCACTATTGACATGTTGGGCTAGA |
| TAATTCTTTGTGGTGAGGGCAGTCCTGTGCATTGTCGGTCACTGGACAGCATCCCTGGCCTCGACCCATT |
| AGATGCCAGTAACATCCTTACTCCAGTCTGTGACTACCAACAATGTTTGCAGGGATTGTCAAAGGTCCCC |
| TGCGGGGTGGGGTGCAAGACCATCTCCAGTGAGAACTGTTGACCCAAACCCTTGCCTGTCTTTTCAAAA |
| AGGTGCCATGGTCACAGGGAGAAAGCAAGGATGGCTCAGCACAAACCGTTTGTGACTATGGGAAGCAATT |
| TTGATGACTGGTCTTCTGAGTTCACCTCTGGAAATTTGTCTCAAAAAAAAAAATCCAAACAAGTAGACAA |
| TAATTTACATACAAACATGTATCATAATGTTGTTTATGATGGATGGCAAAAATTTTAAACAATCCAAATA |
| AAGAATTGGTTGAATAAAGAACAACCCAGATATATGATATATCGATGGAATATTATGCAGTCAGGAAAAA |
| TAATTGTGTACATATATATTTAACAATGTGGAAAGTTCCCTTAATGATACCTTAAACTCTTACCTTTGAG |

| Sequences |
| --- |
| ACTACTGCAAGATTCTCAGAAGTTGTGGTATGTAGAAGGGATGATTTCAAGCAGGCAGAGTAAGCATCTG |
| GGTGAAGTATTAGGCCCAACACAAAATTCAAACCAATGATTGGCTTCAGAAAACTTTACTTGTTAATTGA |
| GTAAACATTTATTAAGCACCTACATACCAAGACCATGCATCACTAGGAAGCAAAGATGACACCTTGTC |
| CCTCTACTGCAGTACTTGCCCCAAACAGACAAAACACGGTGAACACCATCAGGCCATCCTCCACACAGTG |
| ATGCGGGAAGGCTCTGTATTTACTGTCTCCCATACTGAAATCTGTACTCTAATTCCAGGTTTTGGGGGTA |
| ACTGGGACTACATCTCATTTTCTTCTTCATGCCTGATTATTCACACCAAGTTAAAAATATTGCCTTTACT |
| GTTTTATAGATTCAGAAATATTTAGAGCATTGTCCAATGACATGGGTCCAGACATGGAACCTACCCCAGC |
| AACTCTGAGAAATGGGCATTCAATGATCTCAGCTTTTTTTTTTTTTTTCCTCAGAACAAAGAAAATGAC |
| TCCATAAGATGGCTATGAGAATAAATAAAATAATGCGTGTCAGATATTCTGAGGGCATATAGCAAGCCTC |
| CAGAGGAATGGTTGGGGTTTTTAAAAATTATTTTTATGAATGGCCATGGTAGCTAAAATTGCAAAGCAAA |
| TATATCTAACTGCCTTTGCTGTTTTATTTTTCCCCTTAGCACTTACCACTCTCTAATACACTATATGATA |
| CATGTGTTTTTGTTTACTGTCTATCCCACTCCATTACATAAAATCTTTGAGCTTTGACAGTGGGTTAAGG |
| ATCCGGCGTGAGCTGTGGTGTAGGTCACAGATGTGGCTCGGATCCGTGTTGCTGTGGCTGTGGTATAGGC |
| CAGCAGCTACAGCTGCAATTTGACCCCTAGCCTGGGAACCTCCATATGCTGCAGGAGCGGCCATAAAAAG |
| ACAAAAAAAAAAAAAAAAAAAAAAAAGCTTTGAGTCTATTTTTCATCTCTTGGTGCCTGGCAGGTATGT |
| AGGGTCTCCATATTTCCTGAAATGAGAGTGAAAAGAGGGGGCCTGAAATCATTTGCCCCCACAGTACCTT |
| GAGCTTTCCCCTCACCCTTCTCAAGGTGCCTAGGCACTATGGACGCCTCTCTCCCTACAGGCTGGCATTC |
| TGTGCTCTAATTTTCTTTTTTTCCCCTCCTCTCCCTCCCGCAGGATGCCTTTGTGGAGCTGTATGGGCCC |
| AGCATGCGGCCTCTATTTGATTTCTCCTGGCTGTCTCTGAAGGCGCTGCTCAGTCTGGCCCTGGTGGGAG |
| CTTGCATCACCCTGGGTGCCTATCTGGGCATAAGTGAAGTCCACGGGCCTGCCACAACAAATATGCAA |
| AAGGTTCACTAAAGCAGTAGAAATGATAATGCAGTGTCAATGACGTACCATGCAAAGAAGCTGTGGTCTC |
| TTAAACACACACAAAAAAACCAACGAAAAACAGATTTCAGGCTCAATGTCGAATCAGCTACTTACTGCC |
| AAAGGGAAATACAATTTATTTTTTACATTATTAAGAAAAATAAGATTTATTTATTTAAGACAGCCCCGTC |
| GAACCTCCTGTTTTTGGAACTCTACCACTAATTATCAAGCCACCCCTACCACCACCACCTCTTACAGCTC |
| CGCCTGAATCTCCTGTGCCTATAAACACGGATTTCTGTTCCATGTTGTTGGCTAGACTGACTCACCATCT |
| GAAAAGCAAACAAACTGACAAAGGACTAGACTGTTCCAGAAGCCAGGTTTCTGGCTGCTGGAGGTTAGGA |
| AGAAAGTATTCACTTTCTTTGCCTTTTTTTTTTTTTTTTTTTTTTTTTTGTTCTGAAGGCTGTGATA |
| TCAATAGAGGGAAGGTGCTTGGAGGGGACACTCTTCTTCCCAAGAAGGAACAGGAGTTTTGCATATGGTA |
| CACACCCGGCTGGAAGAAACAAATCCAGAACTTCAGATGGACTTGGTATTTGCCAAGATTTCCACCCCGA |
| AGGACAGTGATGAGAAAATGCCCTTAAACCATAGAAAAGTATTTTTTTAAGCTACCAATTGTGCCCAGA |
| AGCATTTTAGCAATTTATACAATATCAACCAGTACCTTAAGCCCTGATGTGTATATTCATATATTTTGGA |
| TACGCTCCCCCTCCAATTACTGGCTCTCTCTCCGTATGAAACAGAATCCTCTGGAATGCGAGGAAGTGAA |
| CGTTTCGGTGACTTCTTCGGCATCAGAAAGCATCAGGCCGCCACAAGTGCCTGCTTTTCTGCAAGAGGCT |
| GCGGTCAGGGGTTCTACCTGGCCCCGGCTCAGAGGCGTCATCCTGGGACTGAGCCTGGGCACACGCTGTC |
| CTGCACCAGGGGTATGAAACGGAGCAGTGTGGTCTATGAACGTCCAGAAGCTGAGGGAGCTCAGAATTGT |
| GCCGGCAGGAAAGAAGGCAGGAGGCCCGGGGCTGCTTCTCCCGCCCCAGGGTTAGGCCCCTTTCCGCCTG |
| GAGCGTGAACCTGGGAGCTAAGGCTCTTAAGACTTTTATCACTGTGGAGAGAAGGAAAAGGAAAAGCAGG |
| CACTGCCCCTTTCCTCGCAGAGGTAGGCGGGAAGCTGAGGATGCCGGATGCCCACGCCCACGGGGAAACA |
| CGTGCGGTCCCTGAGCACTGTGGCCGGTGTGCCTGCGCATTGGCTGTGCAGCCACCAGCCAGCCTGTCTG |
| TGCGGCCACCAGCCAGCCTGTCTGTGCAGCTTAAAGCAAGATTTTAAATGCTTCGGGAAGGTCATAAATC |
| CTAAAGGAAGCGTTGAAATGACGTGTCATGGATTAACTGACCTATGTCTGTGGAATTTCGGTAAAACATT |
| ATCTTGTCATTGTAGTTTGGTCTCATTTGAAAAACCTGACAGAGGGGGGAAAAGTTCCAGGTATGGAATG |
| TGGGGATTATCTGTACATCCTGGGGCGTTAACAAAGAAAAAAGGAAAAAAACAAAAAACAAACAGAGGTA |
| AAAACGCCATAGAGCAGAGAGGTAGCAAAAGAAGTGAAATCTCCAGCTTATAAACGAGGGAAATAGTTTTT |
| CAAGTTTAGAATCAGCCTTGACACACGCATGGAATAACTGTGGCATTATTGCATTATATACCATTTATCC |
| GTATTAACTTTGGAATGTACTATGTTCAATGTTTAATGCTGTGGTTGATATTCGAAAGCTGCTTTAAAA |
| AAAAAAAAAAGATACATGCATCTCAGCATCTTTTAAAAAAATTATATTTAGTTATGGCCTCTACACTATT |
| TGTAGATCATTTTTCCACTTGAGAATTTTGTCTCTTAATTCTTTAAAAGCATTTCTGAGGAGGATGAGATA |
| AGCCCTGGGTCTCAGCTACCTGAGAAACCCTGGAACATGCAGGCCACTGAGCCACTTTGCTTCAACCAAG |
| TTATGTCCACTTCCATGTCAACAGAATTGTTTATTGTGAGGGACGTACCTGTTACCCCTTGACCTTGTTC |
| CTGAGGTTTACTTGTCCTAGGCCAAATCAGAATTGAACTCACATTATTTAGGATTGCATACATATTTGGT |
| TAAACCCATGAGGTTCATTCAGTTGGAAATCCAGATGGGAAATGACCAGGGAATTAAATTCTGGCTACAA |
| CGGTTTGAGCTTTAGAGAGATGGTTTGCGTGGCCTGTCTCCACGTAGACCTGTCTAGAGCCCTCCCACCT |
| TCCTTCCAGAGGGCCCTTCTCGTGGTCATCCTCACATTCTTTCCAGTCAGGTCAGGTGCACTTACACCCCC |
| ACACGGAGAAAGCAGGAAACCCCATGGTATGAAGCCAGACCTCCCTGGCGGGCCTCAGGGAACAGGACGC |
| TCAGACTTTGAATGATTCTAATTTTGAAGCAAAAGGTTATTTTATGAAAGGTTTACATTGTCAAAAGTGA |
| TGAATATGGAATATCAAATCCTGTGCTGCTATCCTGCCAAGATCATTCTGACGGAGTCGGTCTGCAGTAC |
| ACTCCAGTGATGAGCCCCTCAAGCTGCTTAGTAGTAACCATAAAGAACACAATTTTAATATAAAACCTG |
| TTTGTCTTTTGTTGTCGTTGTTTTCAAACTTGGATTCACAAAGTATTCTAAAAATGTATATATAAAAAA |
| GGTCACGGGGGCTAATTGCTGGCTGGTTTCCTTTCGTTGCTGGCTTATGATACCTGGTTTTCAGGATAA |
| ATGTTCCCAGCCGCCTGCCCCCAGAACTGTACAGTATTGTGGCTGCACTCTCTCTAAGGGTAGTTGAAG |
| TTGCATTTTCTTGTTGTTAAAAACATGTTAGAAGCAATGAATGTATATAAAAGCCCCAACTAGTCTGTT |
| TTTCTCCTCCCTTTTCTTGGCATTGTCTCAGTTATTTTGCCGTTGGACAGCATTCCTATTTTGTGTGACA |
| GGATTCGCCCCTGAATTACCATCGGCGTAGTGCATGTGTTGACCCAGGTCAGGGTTCAGTAGAACATGTT |
| TCCAGATGGAGGTCAAGGGCTCTAGAAAAAAGCCACAAGGAGAAAAGCACTCCAGAACCTCCTTGGTCCT |
| CCCGAGCCCTCACTGCACAAAGCAGTTCAAAAGAGAGAGCAAAATGACAGCTCACCATCTTCTGCAGCAA |
| ACAGCTCATCTCAGATTTTACGGTGGCTGAAACGTCTGGAGGTTTAAGATTTGGATTAAAGTCACATTTC |
| AAATTAAGGAAGCACCTCGCTGTAGTTCAAGCCCCAAACCAACATCCTCTGCCCCAGGCCACTTATCTCT |
| GCATAGTCAGACATGACCTCCCATTTAGATGTGACTTTGATTTCATTAGTAAATATTTATGCTTACCATC |
| TAAAGACCTGGTGCTGGCCCAGTGTGGGAAATTAGGAAGTGGTTATAAATCAAGAAGAGTTTGAATAATC |
| AGGATTAAACTTAAATAAGTAGGACAGTCCCAACATGCATCTGGCTTTTTCTGCATCGAGGATCTATGGA |
| ATGAATAGAATTGAAATTGTCTGTATTGTCGTTAAACTTATGCTAAAATGATGAATTTATACATGTGAA |
| CCTAAATTCTAATTTCCATTGTACTTGTAAGGCAGCAGCTGTTTTTTCACTTCCTTATCACCTATAGTTA |
| GTAATGTATACCTCCTCTATCAGAAAAAAAAAAAAAAAAAAAACAGGAAGGGCTTGAAATATAAGCCAT |
| TT (SEQ ID NO: 41) |

-continued

Sequences

Human ETV2 (Gene ID: 2116)
Location: chromosome 19 Exon count: 7
Range: 35641175..35644871 (3697 bp)
>NC_000019.10:35641175-35644371 *Homo sapiens* chromosome 19, GRCh38.p12
Primary Assembly
ATTACAGGCGTGAATCACCGCGCCCAACCACAAGTTACAGACATTATAACATTTCATCTCTGAGTTCATT
TTCTAAATGATATCTTTCCTCCTGAATACCATTATCAAATCTAAGAAAAGAATTCTATGATATTTCATAT
TCAGTTCATACTCCAGTTTCCCCAATTGTCCTAAACTATTACAGCGCGGAAGGGCATGGGGTCTGGAGAA
GGAGAGCAGTGGGAGGATGCCTGCCTTACCTTCCCCCTTCATCAAATGAGAGTATGTATTGTACTTGCCT
CATAGAAGGATTCAATGAAGGGGTATGGCACAGTTGGTTTCACACAATGAGCCCTCATTTAATGTTGGCC
GTTATTGCTACTATTGTTATTGTTGAAATTGTTGATGTCAATATTGCTATGATTGGCACTCCTGGGAAGC
AGCCCCAGGACGCCCTCCCTACTGGGCCTGGTGGAGGATTGGGTGGGCCTTCACTCCTGCTCCACGCCCC
CGCAGTTACTCTGCCGATTGTGACGTCAGCTGACGCTGGGGGCGGGTGGGGGAATCTGGCCGGAAATCCC
TCTTCCTGTTGCAGATAAGCCCAGCTTAGCCCAGCTGACCCCAGACCCTCTCCCCTCACTCCCCCCATGT
CGCAGGATCGAGACCCTGAGGCAGACAGCCCGTTCACCAAGCCCCCCGCCCCGCCCCCATCACCCCGTAA
ACTTCTCCCAGCCTCCGCCCTGCCCTCACCCAGCCCGCTGTTCCCAAGCCTCGCTCCAAGCCCACGCCA
CCCCTGCAGCAGGGCAGCCCCAGAGGCCAGCACCTATCCCCGAGGCTGGGGTCGAGGCTCGGCCCCGCCC
CTGCCTCTGCAACTTGAGCCTGGCTGCGACCCCTGCTCTGACGTCTCGGAAAATTCCCCCTTGCCCAGGC
CCTTGGGGGAGGGGGTGCATGGTATGAAATGGGGCTGAGACCCCCGGCTGGGGGCAGAGGAACCCGCAG
AGGTGAGCGATGAACTGAGGACTAGATGCCTGGGTGTCTGGGTTAGGAAGGACCTGGGGGACTAGACTCC
CAAGAAGCCGGGGCCTGGACTCCTGGGTCTAACAGAGGAAGAGAGCTGGGGTCCCTCACTCCCAGGACC
AAGATTTTAGGCTCCTGGGGAAGGAGGGAGCGGAGGCCTGGACTCCTGGCTCTGAGGGAAGCTAGGGCTG
GGGCCCAGACTCCAGGGCCTCCAAGTGTCACCAGCTCACCCATTGCCATCTGGACTTTTCCCGACCCAGA
ACATTCAGAAGGCCTTCATCGCATCCATGGACCTGTGGAACTGGGATGAGGCATCCCCACAGGAAGTGCC
TCCAGGGAACAAGCTGGCAGGGCTTGGTAGGCTGCCGAGGCTGCCACAACGTGTGTGGGGAGGGTGTCCA
GGTGGGGCCTCTGCTGACCCTAACCCCTTATCGCCTGCAGAAGGAGCCAAATTAGGCTTCTGTTTCCCTG
ATCTGGCACTCCAAGGGGACAGCCGACAGCGACAGCAGAGACATGCTGGAAAGGTGGCTGCGGGCTGGG
ACCCCTAAGTGCTGGAGAAGAAGCGGGGAGGCTGGGATCCTAGGGCAAAGGGAGGAGGGGGCGTGCCTA
GGTTCCTGGGACTGGGTGGGGAGGGGCCGCGTGCTTGACCCCTGAGGGTGAAGGAAAAGGGGGCGCGGGG
TGCTGAAATACGGGCTGGGGGGCCATAACTCCCAGTCCCTGACAAGTAGAGACTAGAGAGTGGGTAGTTG
AGGGGTCTCTTTCATTGCTCACAGTCCTCCCTAAACTCAGGTACAAGCTCATCCCTGGCAAGCTTCCCAC
AGCTGGACTGGGGCTCCGCGTTACTGGACCCAGAAGTTCCATGGGGGCGGGTGAGTGTGGGGAGAGGCG
GTGGGAGGTGGGGACTGGGGTCCCGAGGCACCGGGGCTAGAGGTGTAGACTCCCTGATCTTTGAGGACTG
AGAACACCTGCGCCCTCAAGGTGGCATGACCTGGATCCGGGTCAGCCGGGCCCCAAGTGCCAGGGTTGAG
AGCTTAGACCCTAGAGTTTTTGAGGGGGCACCTGGGCTCCCCTCACTCGGGATCCGTTACTCCTCACAGA
GCCCGACTCTCAGGCTCTTCCGTGGTCCGGGGACTGGACAGACATGGCGTGCACAGCCTGGGACTCTTGG
AGCGGCGCCTCGCAGACCCTGGGCCCCGCCCCTCTCGGCCCGGGCCCCATCCCCGCCGCCGGCTCCGAAG
GCGCCGCGGGCCAGAACTGCGTCCCCGTGGCGGGAGAGGCCACCTCGTGGTCGCGCGCCCAGGCCGCCGG
GAGCAACACCAGCTGGGACTGTTCTGTGGGGCCCGACGGCGATACCTACTGGGGCAGTGGCCTGGGCGGG
GAGCCGCGCACGGACTGTACCATTTCGTGGGGCGGGCCCGCGGGCCGCCGGACTGTACCACCTCCTGGAACC
CGGGGCTGCATGCGGGTGGCACCACCTCTTTGAAGCGGTACCAGAGCTCAGTCTCTCACCGTTTGCTCCGA
ACCGAGCCCGCAGTCGGACCGTGCCAGTTTGGCTCGATGCCCCAAAACTAACCACCGAGGTGAGAGGGCC
GCAAAGACTGCGGGGAGGGCGAAGCTGGAGTCCTGAGCCGGGACCCAGGCACCTAAGGGGGCGGGGCCCG
GGAGACTGACAGTGAGGGGGCGGGGGCTTAGGGACCAGGGGCTCGAAGGAGGGGCCGGTGGCCCGCACTC
CAGGTCCTTGGGGAGGAGAGGGCTAAGAAACTGGTAGTCTTATAGGGACCAAGGGGATGAGGACCCAGGC
TCCTGGATTATATAAAACGAAAGCGATAAAGGCCCAGATTCCTGGGTCTCCGAGATGGGGAGGCAAACT
CCTAAATCTCTGAGACTGGGGCCCTGGACGCTTGAGTCTCCAAGGCTGACTGTTGGATCTCAGAGAAGGG
GGGGCGGATCCCCTTCTCGGGTCCTGGGTCCCGAGTTGGGAGGACCCCGGACCTCTAGATCATTGAAGTGG
TGTGATCTAGGGCCGGGAAGACTGAGTGTGCCCCTCCCTTCATCCCGCAGGTCCCATTCAGCTGTGGCAG
TTCCTCCTGGAGCTGCTCCACGACGGGCGCGTAGCAGCTGCATCCGTTGGACTGGCAACAGCCGCGAGT
TCCAGCTGTGCGACCCCAAAGAGGTGGGGCAGCTCCCCTGCCCAGCCAAATCCGCCCCGTCTCTTCTAGT
TCAATTTAGCTCCGCCCAAGGGCTAGGTTCAACCGCGTAGCCCTCGGCCCCGCCGCTCCCCGGCCCACTC
GAGGCCCCGCCCAACCCTTCTCAAACCCAATCTCCCGCCTGTACTCCTGCCTCAACCAACCCAGTCTCCA
CCGGGCTCTGCGAGGCCTCGCCCAGGTCTGCACTGCACACCGCCCCAGGCCCGGCCCTCCCCACTATCG
CCAAGCCCCGCCCCTTCCCACTCCGACCGAGCGGGCCTCTGTCCTAGGTGGCTCGGCTGTGGGGCGAGCG
CAAGAGAAAGCCGGGCATGAATTACGAGAAGCTGAGCCGGGGCCTTCGCTACTACTATCGCCGCGACATC
GTGCGCAAGAGCGGGGGGCGAAAGTACACGTACCGCTTCGGGGGCCGCGTGCCCAGCCTAGCCTATCCGG
ACTGTGCGGGAGGCGGACGGGGAGCAGAGACACAATAAAAATTCCCGGTCAAACCTC (SEQ ID NO: 42)

Pig ETV2 (Gene ID: 100622447)
Location: chromosome 6 Exon count: 6
Range: 45085984..45089592 (3697 bp)
>NC_010448.4:45085984-45089592 *Sus scrofa* isolate TJ Tabasco breed Duroc
chromosome 6, Sscrofa11.1, whole genome shotgun sequence
ACTTCCTTACGCAGCGGGTGCAGCTCTAAAAAGAAAAAAAAAAATTTGCATAAGTGTGTCCCAAATATT
GCATGCATGTAAGTATATGTTACAAGTATACATGGGTGGGTTTTTTGGCTGAGTCATTGGAAACAAATA
CAGACATCATAACACTTCACTCCTAAATACCTGTTTCATAACCTTATAAAGATAGCTTCCATATCATAAT
ACCATTATCACATCTAAGAAAATGACTAATTATCTCATATTCAGTTCATACTCTAATTTCCTCATGTGCC
TAAACTATGACAGCATGGAAGGGCATGATGGATTCTGGAGATGAAGAAAGTAGGAGGAAACGCACCTCA
ATTTCCCCTTTCATAAAGTCAGGGTAAGACTAGTACCCACTTCCTAAGAGATTAAAACAAAGGCCCATGG
CACAGTTAGTAGCAAGCAATGAGCCCTCAAGAAATGTTAACCATTATTGTCACTGTTGTTATTGTTTATA
TTGTTGATGTTACTGTCTGCTGAAGCAGCCCCAGAACTTCCTCCTCAAAGCCCTCGAAGGGGAAAACAGC
CTGGTGGAAGATCCCAGGTCGACCAACCAACCCCCACCCATATCCCCGCAGGCCCCCTGCGGATTGTGAC
GTCTGCTGACCAGGGGTCTGGCCGGAAATCCCCCTTCCTGTTGCAGATAAGCCTGGTGCAGCCCAGCTGA
CCCCCAGGCCCTCCTCCCCCATCACCTCCCTTGTCACAGGATCAAGTCCCCAAGCCCCCTTCCCCTCCCA
TTCCAGTCAACCCAGAAACACCCCTCTGCACCCCAGGTCATGCCCATCCCATTGTTTCCCAGGCTCCTGC

| Sequences |
|---|
| TCAAGTCCAAGACACCCCAAAGCTACCGTGGAGGCTTGAGGCCATCCCAGGGGGCAGAGGTGGGTGGGGA
GGGGGTGGCACAGCTTGGCCCCGCCTCGGCCCCTGCAACTTGACCCGGGCTGCGACCCCCGCTCTGACGT
CTTGGAAAATTCCCCCCTGCCCAGGCCCCAGAGGAGGGGGTATGTGGTATGAAATGGGGCTGAGACCCC
TGGCTGGGGGCACAGGGATCTGCCAGAGGTGAGCCATGAACAGGGGACTGGAAGACTGGGTGTCTGGGGG
CCCTTCCTCCTGGTGAGAGAGAAAAGGACACTGGAGGCCAAGATTCCAGGGTCCTGGGGAAAGAGGGAGC
AGAGGCCTGGATTCCTCCATCTGAGGGAAGCAGGGGATGGGGCCCAGACTCCAGGGTCCCCAAGTGTCAC
CAGCTCACCCTGTGCTTTTTTTTCTTTTGACCCAGAACATTCACTACTGGCATCCATGGACTTGTGGAAC
TGGGATGAAGCATCGCCAGAGGAAGTGCCCCTGGGGAACAGACTGTCAGGGCTGGGTAGGCTGCTGGGCT
GAGGCCATGTGTGTGGGGAGCTTGCCCAGGTGGGAGCATCCACCGACCCTGACGGGGCTCTAACCTTACT
GCTTGCAGAAGGAGCTGAATTCGACTTCTATTTCCCTGAACTGGCACTCCCAGGGGACAGGCTGACAGCG
GAGACATACTGGAAAACTGGCTGTGGGCTGGGACCTCAGGGTGCTGGAGAAGGTGAGAGGCTGGGCTCCT
AGGTCTGTGGGAGGAAGGGGGAGTGCCTGGATTCCCCGGGTTGAACTGGGAGAGGGATGTGGGCTTGAAC
TCCAGAGCTTGAGGAGGAGGAGGAGGGGGCCAGGGTCCTGAGTCCTAGGCTTGAGTGAGTAGGGGCTGG
GGTCACAACTCTCGTCCCGAACAAATAAAGAGCGCAGGTGAGTGGCTGAGGGGAGTCTGTAGCCACTGTG
CACACCCCTCCCTAAACTCAGCTTCATCCTTATCTGTCCCAGGGATTCCACAGCCGGACTGGGTCTCCGC
ATTACCGAACCCAGAAGCTCCATGGGGCGCGGGTGAGTGTCTCCCACAGTAACTGGAGGTTTCGATTCCG
CGATCTTGGAGGGGGAACGGGACTAGGACGGGGATGCCGGTGTCCTCAAGGTGGCAGGTCCTAGATCCGG
GAGCGTGGGGCCCCAGGCGCCAAGGCTGAGAGCTTTGACTCCTAGAACCCCGAGGGGGCAGGGGATCGG
GACACCTGGGCTCCTCTCACTTGGGGTCCGTTCGTCCTCACAGAACCCGTCCCTCAGGCTCTTCCGTGGT
CCGGAGATTGGACAGACCTGCCGTACAGCGGCTCGGTCCCTTGGAGCCGGGTCTCCCAGGCCCTGGGCCC
CGCCCCCTTGGCTGGCTCGGAAGAGGCAGCCAGCGGAAACAGTGCCACCTCCGCTGAAGGTGCCAACTCT
TGGTCGCGCGCCCGGTCGCCGCCAGCTCCACCAGCTGGGACTCTTCTATTGGCCCTGACGGCGCCACCT
ACTGGGACAAGGGCCTCTGCGGCGAGCCGCGCGCGGACTCTGCCACTCCGTGGGCGGGCCTTCAGGCTC
GGACTATACCACCTCCTGGGACTGGGGCTGCACACGGATTGCACCACCTCTTCAAAGGAGTACCAGGGT
TCAGATCTCACCACTTCCTCCGTACCGAGCCAGCAGTCGGACCGTGCAACCTTAGCTCATTATCCCAAGA
CGAACCACCGAGGTGAGGTTCCCGAGACTTTGTCCCCAGGGAGAGGACCCGGAGTCTAACGAGGCGGGGC
CTAGGCGCCTTAGGGGAGGGACCTGGGAAACTGGCAGGGCTCCAGAGGGGAGGGGACCGTGCCCTTGCTC
CTGGGTCTTGAGGGAGGAGAGGACTGAGACACTGGCCGTCTTCTGGGAAGCAAGGGACGAGGACCAAGGC
TCCTGGATTAAGTGAGAAGAAAGGGATGAGGGTCTGGCTGCCTAGATTTCCAAGGTGGGGCAGCCAAACT
CCTTAATCTTAGAGATGGGAGTCCCGGATGCCTGGGTCCCGAGGCCAACTCTTGGGTCCCTTATATCCG
GACTTGTTGGTCCCGAGGAGGAGAGGATCCGGACTCCTGGGTCATCGAAACGACATGATCTGGGACCAGG
GAACCTGAGTGTTCACGTGCCCCCACCCCGCAGGTCCCATTCAGCTGGCAGTTCCTCCTGGAGCTGCT
CCACGACGGGACGCGTAGCAGCTGCATCCGCTGGACGGGCAACAGCCGCGAGTTCCAACTGTGCGACCCC
AAAGAGGTGGGGCAGCTTCCCACCCCGGCCAAGTCCGGTCCCTGTCGCTAGTGATCCCTTAGCCTCGCC
ATTCGCTTTGCCTAGCGCTAGGCCCCGCCCCCGCCTCGCCCTCATCTCAACTCTGCTCCGCCCCGACTA
AGCACTGTGCAGACTCTACCAGGACCCCCCCCCCCCCACGCCCATCTGTTGTCAAGGCGACCCCTCCCG
CCCTCTCGGACTAAGCCGGGCCTCCCAACTAGGTGGCGGCTGTGGGGCGAACGCAAGAGGAAGCCCGG
CATGAATTATGAGAAGCTGAGCCGAGGCCTGCGTTACTACTACCGCCGCGACATCGTGCTCAAGAGCGGG
GGGCGCAAGTACACGTACCGCTTCGGAGGCCGAGTGCCAGGCCTAGCCTATCCCGACCGCATGGGGGACG
GACAGGGAGCAGCGACCCAATAAAAATATCTGGTCAAGC (SEQ ID NO: 43)

Human NKX2-5 (Gene ID: 1482)
Location: chromosome 5 Exon count: 3
Range: 5001..8209 (3209 bp)
>NG_013340.1:5001-8209 *Homo sapiens* NK2 homeobox 5 (NKX2-5), RefSeqGene on
chromosome 5
GCTCCTGTCATCGAGGCCCCTGGCCCAATGGCAGGCTGAGTCCCCCTCCTCTGGCCTGGTCCCGCCTCTC
CTGCCCCTTGTGCTCAGCGCTACCTGCTGCCCGGACACATCCAGAGCTGGCCGACGGGTGCGCGGGCGGG
CGGCGGCACCATGCAGGGAAGCTGCCAGGGGCCGTGGGCAGCCGCGCTTTCTGCCGCCCACCTGGCGCTG
TGAGACTGGCGCTGCCACCATGTTCCCCAGCCCTGCTCTCACGCCCACGCCCTTCTCAGTCAAAGACATC
CTAAACCTGGAACAGCAGCAGCGCAGCCTGGCTGCCGCCGGAGAGCTCTCTGCCCGCCTGGAGGCGACCC
TGGCGCCCTCCTCCTGCATGCTGGCCGCCTTCAAGCCAGAGGCCTACGCTGGGCCCGAGGCGGCTGCGCC
GGGCCTCCCAGAGCTGCGCGCAGAGCTGGGCCGCGCGCCTTCACCGGCCAAGTGCGCGTCTGCCTTTCCC
GCCGCCCCCGCCTTCTATCCACGTGCCTACAGCGACCCCGACCCAGCCAAGGACCCTAGAGCCGAAAAGA
AAGGTGAGGAGGAAACACAGGCCCCCTTCTCCCCTCCTGGGTCGCTTTCGTCCCAAGAAACTCAGGGCC
AGGAGGAGGAGACACGCGCCCTTGGGCCGAGGGCTGGGCTGCGGCGGGGGGTTCAGAATGTAAGATGCCT
GGTGTTGTCGCCAGGCTCCCGCGCCCCGCGTCCAATCGGAGGTTCAGAGGAAATGCCGGATTGAAAGGAT
CAGAAGCAAGAGACCAAAAAAACGTTTCCCCCCGGCCTAACAAAGCCCCGGGCGGCTTCGGCTCTGCTCCT
GGGTCTGGTAGGAAGTTGAGAAATCGGTTTATGGTAGACAGAACAGAGAGACAAGCAGATAATCTCTGTT
TTTAAATCTCCTTTGGATTTACGAATCTTTTTAAAGATCTGATGAGAACCGCTAAACAGAAATTGAAATG
TTGCTCACCAGACAGCTTTTGCGTACAATCGGAGGAGGGTCCTGGACCTTCTTTCTGCAGCCCACCCACG
ACCCGGGTTTCTGGTGCCTTTCTTTCTTTGCGCCAGGAAAGTGGAGTCTGGGATCGAGGGCCTTGATTTT
AAAATGGGATACTGCGGACCCTCAGGAATCTGACTTCACTTTATTTTTTCAGCACAACTTGCCGGCGCGG
CCAGGGCGGAGAGGTTCCCTCGTGAAAAGTTAGGAAATGCTGCGCTACCGCGGGCACAAGGGAGTGGAC
GAGATGAGTGCGGGATCATCCCGCAGGCCATCCCAGGATCGGGGAGGGAGGCCGGCCCCGCTGCAGAAAG
GGGCCTTCTGGGAGACCCCCCAGCCCAAGGCAGGAGCCCGGGCGATTCCCGGGAGGCCGCAGGCGCTGGG
CGAAGCGCTGGGCGAAGGGCCGCTGCCAGCCGGGAGAGAATTCATAGGTTTGTTGAGGAGCAGAGGCCTG
GGAACAAATTCGGGCGGGCACGGCGGCTAGAACTGATCGCTACCAATTCGAGGAAGCCAGCAAGGCAGGT
TCCGAGGCCGCCTGCCCACCCGCAGCTTCTTGGACACTGCGCAAACCCTGCTGCGGCCAGGCTGGAGCCT
CCGATCACCAAACCAACACTCCCTGGCCTTCTGTTTCTTGATTCCTTAATTTTGAGATAAGACCGTCCCT
AGCAGTGAGGCCTCGGCCTCTGTTCATTTAACTTCTCAAACCAAACTAGCCCTAATTCAGTTCACCCCAG
AGCATCACCTGGTTTTATTTTTATTTTTTATTTTTTATTTATTTTTTTTTTTTTTGCAGCCTGAAATT
TTAAGTCACCGTCTGTCTCCCTCACCAGGGTGTGAACTGCCCCGAGGGCAGAGACCTCCCGTTTTGTTCT
CCAGCGCCTTGAGCCAGCCTGACTTTCTACAAATGCTGAGTGAGACGTGTCGGTGGCTCCCAGTGCACTT
GGCAGAGTGAGCCGCAGCCAGCTGGGCGCTCCAGGCAGGACACAGTGGCCTCCACGAGGATCCCTTACCA
TTACTGTGCGGCCGCGCTCCGTAGGTCAAGCCGCTCTTACCAAGCGTCTCTCTGCCTCTCTGTTCCCCCT
CAGAGCTGTGCGCGCTGCAGAAGGCGGTGGAGCTGGAGAGAGACAGAGGCGGACAACGCGGAGCGGCCCCG |

```
GGCGCGACGGCGGAGGAAGCCGCGCGTGCTCTTCTCGCAGGCGCAGGTCTATGAGCTGGAGCGGCGCTTC
AAGCAGCAGCGGTACCTGTCGGCCCCCGAACGCGACCAGCTGGCCAGCGTGCTGAAACTCACGTCCACGC
AGGTCAAGATCTGGTTCCAGAACCGGCGCTACAAGTGCAAGCGGCAGCGGCAGGACCAGACTCTGGAGCT
GGTGGGGCTGCCCCCGCCGCCGCCGCCGCCTGCCCGCAGGATCGCGGTGCCAGTGCTGGTGCGCGATGGC
AAGCCATGCCTAGGGGACTCGGCGCCCTACGCGCCTGCCTACGGCGTGGGCCTCAATCCCTACGGTTATA
ACGCCTACCCCGCCTATCCGGGTTACGGCGGCGCGGCCTGCAGCCCTGGCTACAGCTGCACTGCCGCTTA
CCCCGCCGGGCCTTCCCCAGCGCAGCCGGCCACTGCCGCCGCCAACAACAACTTCGTGAACTTCGGCGTC
GGGGACTTGAATGCGGTTCAGAGCCCCGGGATTCCGCAGAGCAACTCGGGAGTGTCCACGCTGCATGGTA
TCCGAGCCTGGTAGGGAAGGGACCCGCGTGGCGCGACCCTGACCGATCCCACCTCAACAGCTCCCTGACT
CTCGGGGGAGAAGGGGCTCCCAACATGACCCTGAGTCCCCTGGATTTTGCATTCACTCCTGCGGAGACC
TAGGAACTTTTTCTGTCCCACGCGCGTTTGTTCTTGCGCACGGGAGAGTTTGTGGCGGCAGTTATGCAGC
GTGCAATGAGTGATCCTGCAGCCTGGTGTCTTAGCTGTCCCCCAGGAGTGCCCTCCGAGAGTCCATGGG
CACCCCCGGTTGGAACTGGGACTGAGCTCGGGCACGCAGGGCCTGAGATCTGGCCGCCCATTCCGCGAGC
CAGGGCCGGGCGCCCGGGCCTTTGCTATCTCGCCGTCGCCCGCCCACGCACCCACCCGTATTTATGTTTT
TAGCTATTGCTGTAAGAAATGACGATCCCCTTCCCATTAAAGAGAGTGCGTTGACCCCG (SEQ ID NO: 44)
```

Pig NKX2-5 (Gene ID: 10052141)
Location: chromosome 16 Exon count: 2
Range: 51086014..51089165 (3152 bp)
>NC_010458.4:51086014-51089165 Sus scrofa isolate TJ Tabasco breed Duroc
chromosome 16, Sscrofa11.1, whole genome shotgun sequence
```
CCTGTCAACGAGGCCCCCGGCCCAATGGCAGCCTGAGTCCCCTCCTCCGGCCTGGTCCCGCCTCTCCTG
CCCCTTGCGCCCCGCATTACCTGCCGCCTGGCCACATCCCGAGCTGGAAGGCGGGTGCGCGGGCGCGCAG
CGGGCACCATGCAGGGAGGCTGCCAGGGACCGTGGGCAGCGCCCGCTCTCTGCCGCCCACCTGGCGCTGTG
AGACGCGCGCTGCCACCATGTTCCCCAGCCCCGCGCTCACGCCCACGCCGTTCTCGGTCAAAGACATCTT
GAACCTGGAGCAACAGCAGCGCAGCCTGGCCGCCGGGGAGCTCTCCGCGCGCTTGGAGGCCACCCTGGCG
CCCGCCTCCTGCATGCTGGCCGCCTTCAAGCCCGAGGCCTACGCGGGGCCGGAGGCCGCAGCGCCCGGCC
TCTCCGAGCTGCGCGCCGAGCTGGGCCCCGCGCCCTCACCAGCCAAGTGCGCGCCCTCCTTCTCAGCCGC
CCCCGCCTTCTACCCGCGTGCCTATGGCGACCCCGACCCCGCCAAGGACCCTCGAGCCGATAAGAAAGGT
GAGGAGGAAACACAAGCTTCTTCTCCTCTGGGGTCGTTGTTGTCCTCAAACCCCGGCGGACAAGAAAC
TCTGGCCTTGGGTAGAGGAGACGCGAGTGCCTGGGCGACCGGTCGAGCAAAGGGGCTCCGAGTGTGAGA
AGCGAGGCTGTCGCCAGGGCCCCGTGCCCGAGTCCAGTCGGAGGTTTAGAGGAAATGCTGGATCGTGAT
GATCAGAAACCAGAGACAAAAGAGAAAAAAACAAATTTTTTTTTCGGCCTAACAAAGCCCCAGGCTGCAG
CAGCTCTGCTGCTCGATCTGTTAGCGATGTTTGTAATAGACAGAACAGAGGGAGGAAGAGAGAATCTTTT
TTGTTAATCTCTTAAGGATCTTTTTGAGCATCTGACAAAAACTGCTAAACAGAAATGTAAATGCTGCACA
CCAGATGTACTTTCGTGCACAATAGGAGAAGGTCCAGGACTTCTGTAGCTCACCCGTTTCCCAGTGGTCC
TGGGGGCCTTTCCTCCTTTGTGCCAGGAGAGTGGAATCTTTGAGAACAGGATCTTGAATTAAAAATGGGA
TACTCCGGGGCGCTTGGGAACCTGACTTAACAGCTTTATTTTTCCATAACAATTTCCCCACGTGGCCGGG
GCCAAGAAGTTCTCTTCCTGGATAAAGTTAGAAAATGCCCTGCGACAAAAGGCTTGGGTCGATGGAGCTGA
CTGGGGAAGGTGGCAGGATCTCTGCGCACATCCCCAGGTCCAGGGGGAGGCTGGCCTGGAGGTGGAAAAG
GCGCCTTGGGGAGCTGGCCCCCCGCAGGGTCCTTTCCAACCCGAAAAGGCCAGGGTTCTTTCTGTGAACC
AAGATTTGTCTAGTCGCAGAGGAAGGCCCTGGGAACAGCTGCCGGTGGGCACGGTGGCTTGAACTGGTTG
CTACCAATTCAAATCTAACTCGAGCACAGTGACAGGCAAGTTCTGAGGCCGCCTGCCCACCTGCTGCTTT
TTGGCGGCTGTACAATAACCTGTGGCCGTCGCGGGTGTCTTCCATAGGTCACCAAACCAGCACCTCTTGG
CTGTTTCTTCAGTTGTATAATTTTGAGACAATGTGACCGACCCTTCTGTAGCTCTTAACTTTTCAGACCCAAGT
AGCCCTGATCTAATTCACCTCAATGCATCGTTGGGCTTTATTTTCTTTGCAGCCTGAAGTCTTAAGTCAC
TGTCCATCTCTCTCACCAGAATGTGAACTGCCCGAGGACAGGGACCTCTCATTTTTGTTCTCCTATGCCT
ATAGCCCTACCTAGCACATAGTAGGCATTCAACAAATGCTGATTGTCAAGCGGAAATCGAGTAGTCTAGG
TGCCCAGTGCACCCGGCGGAGTAAGCCGCACCCAAGCTGGGGTCTGAAGGCAGGTCGGGATGCCACCCAC
TGGGGCCCATCACCGGGCGGGAGCTCCGAGGGTCGCAGGTCCAGCAGCTCTGACCTAGCTTCTCTCTGCC
TCTCTGTTCCCCCCCGCAGAGCTGTGCGCGCTGCAGAAGGCGGTGGAGCTGGAGAAGCCAGAGGCGGACA
GCGCCGAGAGACCTCGGGCGCGACGACGAAGGAAGCCGCGCGTGCTCTTTTCGCAGGCACAGGTCTACGA
GCTGGAGCGACGCTTCAAGCAGCAGCGGTACCTGTCGGCTCCCGAACGTGACCAGTTGGCCAGCGTGCTG
AAGCTGACGTCCACGCAGGTCAAGATCTGGTTCCAGAACCGGCGCTACAAGTGCAAGCGGCAACGGCAGG
ACCAGACTCTGGAGCTAGTGGGGCTGCCCCCGCCCCCGCCGCCGCCGGCCCGCAGGATCGCGGTGCCAGT
GCTGGTGCGCGATGGCAAGCCTTGCCTCGGGGACTCCGCGCCCTACGCGCCAGCCTACGGCGTGGGCCTC
AACGCCTACGGCTATAACGCCTACCCCGCCTACCCGGTTACGGGTGCGGCGGCCGCTGCAGCCCTGGCTACA
GCTGCACCGCTGCGTACCCAGCCGGGCCGCCCCGGCGCAGTCGGCTACGGCCGCCGCCAATAACAACTT
CGTGAACTTCGGCGTCGGGGACTTAAACGCGGTGCAGAGCCCGGGGATTCCGCAGGGCAACTCGGGAGTG
TCCACGCTGCACGGTATCCGAGCCTGGTAGGGAAGGGGCCTGTCGGGGCACCTCTAAAGAGGGGCACTA
ACTATCGGGGAGGGAGGGCTCCCGATACGATCCTGAGTCCCTCAGATGTCACATTGACTCCCACGGAG
GCCTCGGAGCTTTTTCCGTCCGGTGCGCCTTTATCCCCACGCGGGGAGAGTTCGTGGCAGAGGTTACGC
AGCTTGGGGTGAGTGATCCCGCAGCCCGGTGCCTTAGCCGTCGCCCCGGGAGTGCCCTCCAAGCGCCCAC
GGGCATCCCCAATCGGCTGACACCGGCCAGTTGGGACCGGGAGCCCGAGCCCAGGCGTGCCAGGCTTAAG
ATGGGGCCGCCTTTCCCCGATCCTGGGCCCGGTGCCCGGGGCCCTTGCTGCCTTGCCGCTGCCCTCCCCA
CACCCGTATTTATGTTTTTACTTGTTTCTGTAAGAAATGAGAATCTCCTTCCCATTAAAGAGAGTGCGCT
GA (SEQ ID NO: 45)
```

Human TBX5 (Gene ID: 6910)
Location: chromosome 12 Exon count: 10
Range: 5001..59513 (54513 bp)
>NG_007373.1:5001-59513 Homo sapiens T-box 5 (TBX5), RefSeqGene (LRG_670)
on chromosome 12
```
CATGCCTTATGCAAGAGACCTCAGTCCCCCGGAACAACTCGATTTCCTTCCAATAGAGGTCTGAGGTGGA
CTCCCACCTCCCTTCGTGAAGAGTTCCCTCCTCTCCCCCTTCCTAAGAAAGTCGATCTTGGCTCTATTTG
TGTCTTATGTTCATCACCCTCATTCCTCCGGAGAAAGCCGGGTTGGTTTATGTCTTTATTTATTCCCGGG
GCCAAGACGTCCGGAACCTGTGGCTGCGCAGACCCGGCACTGATAGGCGAAGACGGAGAGAAATTTACCT
```

| Sequences |
| --- |
| CCCGCCGCTGCCCCCCAGCCAAACGTGACAGCGCGCGGGCCGGTTGCGTGACTCGTGACGTCTCCAAGTC |
| CTATAGGTGCAGCGGCTGGTGAGATAGTCGCTATCGCCTGGTTGCCTCTTTATTTTACTGGGGTATGCCT |
| GGTAATAAACAGTAATATTTAATTTGTCGGAGAACCACAAACCAACCTTGAGCTGGGAGGTACGTGCTCTT |
| CTTGACAGACGTTGGAAGAAGACCTGGCCTAAAGAGGTCTCTTTTGGTGGTCCTTTTCAAAGTCTTCACC |
| TGAGCCCTGCTCTCCAGCGAGGCGCACTCCTGGCTTTTGCGCTCCAAAGAAGAGGTGGGATAGTTGGAGG |
| TGAGTTTCACCCTGGAGGACTGAGGGGGGAAATAGGTTTCTCTTTGCACTTGGCCCTCCTTGGCTTTTCA |
| CCCCGTCTTAGTCTTGCTGAATCTTCTCTTGCTGTGCTGCTACTTCTCATGAACGAAATAAGAATGGCTT |
| CGTGTGTCACCTGGCAAGAATGGATTCTCTCGAAAGGTTTGAAAATCCCTATTTTGCTTGGTGGCCCAGA |
| CCATCTGTGCTCAATGAGCTAAGCAAATCTGGCTGGGCTATTACCTGGGAGAGTCCAGATTTTTCCTCTC |
| TGGAGGGGCCTGAAGATTATTTATGGGAATTAATTTTATCCCCAAATCTCTGAGAACTTAAAGGGATTGG |
| GAAGGTCTTTCTGGATTTCCCTTTCCCTCTACTGGAGATGTAGCGGTTCAGCCTTCTTCCGATGCCATGT |
| TTGTTTTCGTGTCTTCGGCCTAGGGTCGCCTTGCCAGCAAGCCTAAAGGCCTCCAAGCTGACTTGGAGG |
| GTGAGGGTGTTTTCACAAATAAATACATCGCCTGGGCAAAGGGAAAATATCTGTTTGCAAACAAACCTGG |
| AAGGTGGAGTGAGCACCATAGCAAAGGAGGGCTGGCTTTCTCCCCGGTTGCCCCACATTCAGGGTTGGAG |
| ATTCTCCACTTTGGCATTTTGCAGCAATGGCCTGGCCTGGGATTTTAGCAGAGCAGTCACAGAGGGTTAC |
| ACAGCTGCTGACCTCGGGGCATTTCTCCTCCCTCCATCCCTTTCTCCAGACCTTGACTTGCAGGCCCAAG |
| TCTCTTATCAGAACCCTAGAAAAATCAGTATGATGGGGGTACAGGAGGTAAGGATGGGAAACAGAACAGG |
| ACTCCTGACATTTACTCCAAGCACCAATATTCGGTGTCCCAATCTGGGTCTGCTCAGACTGAGACCTACT |
| GACTGTGTTTGTGCTTTTATTGACCTCTTCAACTCACCCTAAAAAAAAAAAATACATCTCAGAGAGGGAA |
| AGGGCAAGGAGGAGGAGACCAGTGGAGATGAAAACCCTAGCCAGTCCCCAGTGACTGTTTGATTATTTAA |
| TAAAACTGGGCACTGCCTTGTGTACACCTGGAGCAGGGGACGTCTGGTGGCCCCACTGGGTGGGGGGTGA |
| GGGCCCGCAGCGATTTCTTAGCATCTTTGATCTCGGCCCCATCCCAATGCACCTTCACCCTGCCTTCAC |
| CCCAGAGTCGTTGAGAGTAGGGGTGATGAGTAGGGGGTGGAGGGGAGATGTCAGGAAGGCGAGCGCCGGC |
| CAGGCGGGGTCAGGCAGCTCTCCTTCTCGAGGTCAGCGTTGGAGAGAATGTCTGCAAGGCTGCGGAGGCC |
| CGCGGTGTGTTTGTGTGTGCGTCCAGACTCGGTTCTCTGCACCGCCAGCGTCACTGAGATTACTTCCC |
| GATTAGAAGCCGACCGCGTTTGAAATGATTTGTGCAGGAGTTTTTGCAGCCACCGCTTGCTCAGAGAAGC |
| AGAGATGGATGGAGGTTGGGAAAGGGGTAGAGAGGAGGGAGTTATTGCAGGTCTGTGTTGAGAGTCGTAT |
| TGTGATTTGAGTGTTCGGGAAATCTAGTGGAAATTTGGGGTGGGGGGAAAGGGAGGACGGGAGGGTGGGAG |
| GGAGAGAGAAGGGGGAGGGCGACAGAGTGCAGTGGGAGCTAGTTGGATAGGCGATTTCAGTACTTTGTGA |
| GCATCGAGGCAACCCAACGTCACTGTGCTCAGCTGAGTTGGCTTGTATTTCAGAGAGAGAGAGAGGGA |
| GAGAGAGTGAGAGAGACTGACTCTTACCTCGAATCCGGGAACTTTAATCCTGAAAGCTGCGCTCAGAAAG |
| GACTTCGACCATTCACTGGGCTTCCAACTTTCCCTCCCTGGGGGTGTAAAGGAGGAGCGGGGCACTGAGA |
| TTATATGGTTGCCGGTGCTCTTGGAGGCTATTTTGTGTTCTTTGGCGCTTGCCAACTGGGAAGTATTTAG |
| GGAGAGCAAGCGCACAGCAGAGGAGGTGTGTGTTGGAGGTGGGCAGTCGCCGCGGAGGCTCCAGCGGTAG |
| GTGCGCCCTAGTAGGCAGCAGTAGCCGCTATTCTGGGTAAGCAGTAAACCCCGCATAAACCCCGGAGCCA |
| CCATGCCTGCTCCCCCGCCTCACCGCCGGCTTCCCTGCTAGGAGCAGCAGGGGATGTGGTGAATGCACCG |
| GCTTCACCGAACGAGGTAACCGTCCCGGCAGATGGCCCGGGAGGCTCAGGAGGGAGCTCGTCGGCCGAGT |
| CGGCTGGGGCGGCGGGAATGGCGGATTCCAGCCCGGCTTTGCATTCTGCAGAGCACAGCTTGCAGAGATT |
| TTGCGCGGCTCGGAGCTCCCCGGCAAATGGAGTCTGGGAGGCCGCCGCGGCTGGCGGAGCGGCATTGAGG |
| TTTGCAGAAGCACGGCCTGGTTCTGTCAAACCGCATCTTGTTCGCCTCCGCCAGCCCAGAGCTCCCCGGG |
| ACCCTGGCGAGGGCGCGGGGTAGGATTCTCCCCGCGGCCGGCAGTGAATGGGAGCGCGTGTAGGGGCGCC |
| AGCCCTGCTTTCTTTTGTTGTGAGTAGGCAGCGGGGCTCCAGTCGCCGCCTCCCTGAAGCCCCGAGAACG |
| AGGCGAAGAAAGCTGCTTGCAAGTCAGGCCTCAGAAGCTGTCCTTCTCCTCGGCCCCATTTCTAGATCTC |
| TGGCCACAGCAGGTCAGGGTGGGATCTGGCCGCTTGCTTAAGCAGCTGCTGAGGTTTTGGGGGACCATCG |
| CTTGTGCCCGCTTCCCAAAGTCTTCCCGTTCTAGGGGGAATTCCTACTTGCGTATAGAAGAGATTGGAAG |
| GAGATCAGAGAGCAGGAGACAGGCTCATCGGGCTTGAACAGCTCTGCGGCAGTTATTTTGTGTGTTCTAA |
| GCTCATACGCCTGCAAACCCGGGCCGTTCTATGCATTGCGGGACCCGGGCTGCAGATTCAATGTCTCCA |
| GCCTAGGACTTATCCGAGAATGATTTTGTCCTCGCCAATCCTGAGCCTGAGCCTGCAGTTTTAGCAGGCC |
| AGGCCTGCTGAAGTTCAGAGAAACCCCTTTCGGCCTGGTCACTCCACAAAATGCCCGCCATCCCCCGCC |
| CGGCATCAGAGCGCTGGTGGCGGGCACCCAGTGACGAGCCTTCCTCGGAACGGCTGCACGGTGACTTTCT |
| TCATCTAGTCTTCTGTTTGGCTACTTTTTATCTTTTAACGAATCTTACTTAAGGTTGGGATAAAGAAAAG |
| GATGTTTAATTTTAAAGGACTTTTAATGTTAAGGCCTGTAACTGGTAAAAGGTGTATATGAATTCTCTTT |
| TGAACCTAGTCTCAATCTGCACAACCTTCCCCTTCTGTGTTTTTCTTTTTGCAAGAGGCGGGTTATTTCA |
| CACATTTCTGCCTGCTGCAGAAAACTATTCCTCTTGTGAGGTTTAATAAAAAGAGTTTCGACGGCATCTT |
| GTAATTTGGCGAAGAAAGAAATTCTCTAAAGGACACTGGGTTTTTGTTTTGTTTTGTTTTTGGTTCCTAC |
| CCAGTGGCTTCCAAAAATACCCACGCCTTATCTTTATTGGCTCTTCCAGAAGTCCAGACAAATTTGACGG |
| GCAGCTTGCTTATCACGGAGAGCCTGCGCAGGGGAGATGCGGGCTTCACCTTCTCCGGGTCTGACGCGGG |
| TCTTTTGCAAGAAGTTGTGCCTGCTTATAAAGTAATAGTAATACTACTAGGAATACTAGTAACAGTAATA |
| ATTCTAGGGCTTCTGCAGTCACCTTCGGCTGGGAACGGAGGTGCTGGTAGCTGGAAACTGGGGGCCAAA |
| CTGCTCCCTCCTGTCACTAGAATTGTGCTCTCCAACCTTTCTCTCGTTCTCTCTGTCCTCCCCACCCC |
| CATCTCCCCCTGCTTCTTGTCCTCAGAGCAGAACCTTGCGCGGGCACAGGGCCCTGGGCGCACCATGGCC |
| GACGCAGACGAGGGCTTTGGCCTGGCGCACACGCCTCTGGAGCTGACGCAAAAGACCTGCCCTGCGATT |
| CGAAACCCGAGAGCGCGCTCGGGGCCCCAGCAAGTCCCCGTCGTCCCCGCAGGCCGCCTTCACCCAGCA |
| GGTAAGGAGACCTCGCGCTTCGGGTCCCTTTGCAGAGATCAAAGTCAGAGTCTGGCTTTCCTGCTCGGCT |
| TCTCTTGCGGGGACAGAACAAAACAAATAAAAAAACCCCAAAACGAACCCAACGACTATAATCATCCC |
| TTTTCCTTTTTATTCCCACTCAGTTCCACCTTTCTCTGCCCTGTCTCCCAAATGCTAGCGTATTGCCAT |
| CTACTTTATTGTGACGGTTATCTTTACGGCCAAAGGATTTTTGAAATCTATTTAAATTGTTCGAGAAATC |
| TCAATTATCCGGCCGTTTGGGGTCAGCTAACAATGGCCTAGATAATTCCTTTCCCTCTGCACTATGTGTA |
| GAATCGGCCCCCAGCATCTTAATAAGGGCCAGGTCAGCGGCCGATTCAGGCCGGCATGAGCGATGGCTTG |
| ACCCCTCTTCTGATCTTCCGTAGCCTTCGCCTCCTCCCGCCTCCTCCTGCCTCCTCCTGCCTCCTCCGCG |
| CCGCCGACTAGACCCGCGCGCCGCACCATTTGTCTTGCGGTCGGGGCCTGGCTGGCTGGCGCGCATCAC |
| CGGCCGCTGGGAGCGCACAGAGCTCTGCCCGGAGGGCACCAGGAGCCTCGGGTTCGCCAGGCTACAACCT |
| GGGCCCAGGCAGAGGGAGGAGCCTCACCTTGCGCTCTGCGCCCAAAACCCAGGACGCACTGGGCGCTCAA |
| GTCGGCCCCTCAGTAGATCCTGGTAATTTTAAATAAGGTGTCACATGGGGTGAAACGGGGTGACGACCA |
| GAAGAGACACTTACACATGGCTAAAATCCTGCCTTGGGATTTCGATCCCTTCCTGGCTTTTCCCGGCTTC |
| TCTCTTTGGCCTTTAAGTTTCAGGAAAACGTGTGTATATTTGTAGAGAAGCAGAGAGCGTGAACACAGTT |
| TAGGAAACTTAGGGATTTTTTTTTTCTTTTAAGGAAAAGCAAACCCACTTTTTAGACTGTTGTAAATTA |

| Sequences |
| --- |
| TTCCAAAATGAAGAGTTTGTGTGTGCATGTATGTGTGTGCACATATGTATATATATGTATATATATAC |
| ATTTGCATCGGTTCTGTAAATTTAGTTTTAGCTGAAAGCCAAAATGTTAAATGGCATCAGGCGTGTCCTA |
| TAATCAAAATAGCTGGATGTGAATGGAACTACTTGTAGAGAGAGCCTGGAAGGTTTGTTAATATAGATAT |
| TTAGGATTAATTATCCTTCTGGACTGTAAGAATATATGATAATAGAAACATTTTTAGGTTTCAAAATTGA |
| TGTATGTTCAGGTTTGCACTCACCATGGTCGAGAATAAGCAAGTATTTGCACATCTGTATGTTTGATGTG |
| TGGGCATCTGAGTGTCTACATGAGAATATTCTGAGTGGTTTTCTAGATTAGGTTCCTAGTTTTTCTAAAT |
| TAGGTTTTTTATCTATCCCCCCCACCCATCTCAGGTGAAGTGGATTGAAATTGGCTCTGGTTTTTTTTTT |
| TTGGTTTGTTTGTTTGGTTGGTTTTTTCTTATTCCGGTCCTCCTCAGTGACATTCCGGAGCACCCTGATG |
| GTGGGTGATCACTCCATAGCCTTGTGCTGATGGCATTAGAAGCAGACAATACAGCACTGTGGGTTCAAGT |
| GGTTGTTGCAACCCTCAGGGATTCAGCCTACATAGGGATCCCTGGGCAGAGGCTGTTGGGTGCTCCAGAT |
| AATTCTGCAGTGGGCTGAAGCCACTTTTTACTCTCTGAGACCACAGGCTCCAGCGGGAAGGAGGAGCAGT |
| CTCTGTGTTTTGGGGGAGTTTGGGGAAGGAATGCCCACTACTGCCAGGGCTTGTTAGTGTGACTTTTTTC |
| TCCTTCTTGCAGGGCATGGAGGGAATCAAAGTGTTTCTCCATGAAAGAGAACTGTGGCTAAAATTCCACG |
| AAGTGGGCACGGAAATGATCATAACCAAGGCTGGAAGGTGAGATGGTTTGTTGTGTAGAGAGAGGGACGA |
| GGAGAAATTGTGGGAGAGGTGAAGAAGAAAAGGTGGCTTGGAGAGAGAAGAAGGAAAGGGGGCAAAAG |
| GAGAGGGAATATAGAGAAAGAAGAGAAAGGAGAGGAGGAGAGAGAAGAGCGAAAGATAGATCCTGGTTA |
| AAGAGGCACAAGGAGATTCCTCCATTGATCTCTCCTAGGATGGAGGAAATACTCCAGAAGTTCAAGCCCG |
| GAAACTGGGCATTTCTCCCACCTCACATATAGAAAGAATAAAGAGCTTGGGAGGCCGTGCTATCTGGATT |
| CGTAATGAGGGAAAGAGAGAAGAGGGAAAGGAGAAAAGAGAAAACAGAGACCCAGAGAAGACAGAGTCTA |
| GAAGGTTTTTGGGTTTCAGGGATCTTGGACTTTATCTTTACTCCAATCCTCATTCCCACCCTCCCTGACC |
| TTGGAGTGGCTCCAGGGTCCCACCCGATTGTCAAACTCTGAATCGTTGGATGTATTCGCTACCTCTTTCA |
| TTGTTTATAGAAAGCAGGCGAAGCCTTTAAAACTGAACCGGGGCTCGGCCGGGCTCTATATACAGACACC |
| AATAAACACGGCAGCTTCGCCAAGACACTCGCCCCGGAGTTCCCCTTAAAAGCTCGCAGAGTTTTAGCTA |
| GAAATGCTAGACTTCTGGGGGAGGAGGAAGGAGAGTGGTGCAGCTCTGTATGTCAGTGTGAGTGTGTGAG |
| CATGTGCACGCGCGCGCCCAGGCCTGGGGACGTCCTGGCCACATCCCTACCCGTGCTGGACGGGTCTTCC |
| GCGTCCCGCAAAGCAAAAGCCAGAGGATGCCCCGAGCAGGCGTGTGGAGCAGGCGAACGGTAGGCCCAA |
| GCCACCGAGTGTGTGAAGGGGGAGGGTGGAGCCGCCTTTCCAGACGCCCCCCGCCCCGTTCTCCAGCCG |
| AAGCCTCCCTCAATAAACTGACAACAGTGACATTTATTATTATTTAAAATTAAACAAAGTCTGCTCCCCG |
| CTCGGCCCAAGGCCTGAGTGAACTAGGAGGCGCGTTCTGTTTATATCAACGAACTGCAGTCCTCTTCCTA |
| TTCCCCCAGGAAGGAAAGCACACGTCCGAGTCCCTCTTTCCCCCCGAGCCTGAGCCGTGAGGATTAACTA |
| TAAAAGGCCTGCGAAGTCTTCTGCGCCTCCGCCTCCGGGCGCGCTCGCTCAGGCTGATAAACACTGCGAG |
| GCTTTGGCTCCGGGGCTCGGAGGGAGAGGCCTCCATTCGACCGTTCCCGCCATCGCTGAGTGAGCCGAGA |
| TCTGCCAACTTGTCTTTTCGCCCCGGGCCAGCCTTGAGAATCTTTGCTTTCTGGGGCATGTTCCTCAGAA |
| GGTGGAGGGAAATTTGGAGTGCGCCAGGGCGCAGAAAGGCAGCAGAGACGGCACAGTTCCGGGCCATCGG |
| CTTGATAACGACTGAATCTTAGTTCAGGCCTCAGCTTTTTCTGAAACCAGATCTGGAAGGGTCTGGAATT |
| TCTTTGCTGAAGGCCAAGGAATTTCGACTCTCCGAGGAAGAGTTTCAGGGGCCTTGGAGAAGTTGTGGGG |
| GCATTCAGGAATAAACTCCTGCTAGAGACCCATGTCAGAGGTCATTAACCGAGTTATACTGGGAACGCG |
| GCCTTCCCCTTCCTCCAGCGGCAGAGGACCAAAGCAAGGTCGGGAAGCCTGGGCGCACCCACGCGTGTGC |
| ATCTCTGGGCGCACACACCTTGTGTACACGTGACACCTTAGCAACGCGAGGATCGGCGGAAGCACCTGG |
| CTAGACAGATCCTCTAGGATCAGCGCCTAGCATTGTACCTAATAAGCCTCCTCTCCCCACAAATATTAAT |
| AATAGGTGTCTGGCTCCGAAAAGGGCGGTTAGCAAGAGTTGAAATGGAGGTCCCTTTGAAGCATCTTCAA |
| AACCCGTTCTCTAGAGGCGCATGCGTCCTGGTTTGTTTTCCGCTTAGGTTACCTACAGTTGCCCGCCTGC |
| TGTTACCTCCTCCCCTTCGCCTTTCTCCTCCCTATAACTTCAAGGGAAACCCGGGATGGATCTTGCGGAGA |
| GCGGAACGGGGCTAGTTTCCGCTTCCACGTTTCTCCAGGAATTGCTTTTTCCCTTAAAATGGATGGAGGC |
| TGCCTTAAAATACTGGCATTAATTCCCGCCCCCCTCTCTCCCTCCGTCCCTCTCTCTTAGGCGGATGTTT |
| CCCAGTTACAAAGTGAAGGTGACGGGCCTTAATCCCAAAACGAAGTACATTCTTCTCATGGACATTGTAC |
| CTGCCGACGATCAGAGATACAAATTCGCAGATAATAAATGGTAGGGACTGGGGTGGCAGGTGGAGCGGGG |
| AGAGAGAAAAGTGGAACCTTCTCCCAAAAAGTTGAAAAGTTGTATCAGTGAACTTTTTTTTTTTTTTTAG |
| TTCCTACTGTGTGCTAAAGGCGTCTGTCCGCCTATCCCATTGCTTTTTTACTAACCATTCTCAGACAAAGA |
| AACTACAACAATTAGCTCCGGTTTTCCAGATGAGAAAGCGGAGGCTCAGAGGAAGTGAGGTGCCTGTGTC |
| TATTGCTGCACCCACAGGTTGTGGATTTTTACAAAGGGTATTGTTACCAAGTGCTGGAGGTATTTCTGGG |
| GGCATAAAACCATTTACAGTTATTTTTTATGAGTTACCTGCTTTGAACATGCATTTTTATGAAATTGCAA |
| AATCGACTCGTGGTATTCGAGTTAAACAGTTAGGAGAGGCCCATTTCTTGGGTAGAATCGTTCCGATGGC |
| TGCCAGCAGTGCAGGGGCCTGACGATGAAACCCCGTTGAAAGCCCTCAAGGAATTTTCAAGGCTTTTTG |
| CACGTCCAGACCTCCAGAACCCGCCCACTTTTTTGTGGGATGCGAGAGGCTGTAAGAAGAAAGGGCTGGGC |
| CAGGGGCTTGCCTGGGCGCAGGCACAAAGTATTCTGGGGCAGCTGGGATTGCAGATACCTAAGGGAGACG |
| GGAGAGCCTCCAGATTATTCCCAGCTACTACTCAACAACCCTCACCTGGTGCGTGAACTGAAGCACGCTT |
| CGGTGCAGTGCGCTACCTCCAGACTCTGAGCCAGGCCTCTAGTACACCTCTCCTTCATCTAGGTCTGTGA |
| CGGGCAAAGCTGAGCCCGCCATGCCTGGCCGCCTGTACGTGCACCCAGACTCCCCGCCACCGGGGCGCA |
| TTGGATGAGGCAGCTCGTCCTTCCAGAAACTCAAGCTCACCAACAACCACCTGGACCCATTTGGGCAT |
| GTGAGTACCGTGGCCTGGATTCCCCGCCTTGTCTCCCTCTTGTCTCTCTCCCCTTCTTCTCACTGGGTTT |
| CTCTCCCTTCTTGGCTCTGTGTGCCTACATTTCTCCTTTTCTTTCCTCCATTTTCCCCCACTTTCGTCGC |
| TTTCTGCCTCTACCTTCTTGATCTGGACTTCCTTCCTCTTCCTTTTCCTCCCCTCCGTCTCAATTCTCTC |
| ATTCCTTTCTCTTCTTTCACCTTCTCACTTGCTTTCCCTTTGCTTTCTTTTTCTTCCTACTATTTCATCC |
| TCTGTCTCCACTACTCTCCTACACAGACATCTGCCCCTCTGCAGTCCTCCCGGTGATCCACACTCCCCAG |
| ATCTGGGTCTGTCGTTCCTTGGTGGCTGGAGATATGGCCCCCGGCTCACCTGGTCTGGGGCTGCATCCTT |
| GCCGTTAGGGCCCAAACCCTCTCCCTTTGCCTAGGGATGGAGGAATGATTGAAGCTGCTCATTCCAGGCC |
| TGGAGAGTCTGTGAATTCGATCTGTCGTTAGGAGTGGAGGGCTGTGTTTCAGTCTTGCAGAAAATATGGA |
| CCTCCTAGCCCAGTGGATACCCAGTATAGACTGCACAGAGGCTGGACCACAATGAAAGCCATATACCTTC |
| CCTCCCCACTTCTCAATCCTGCCTTAATTTTGGGATGTTCCAGGGGAGAGGGAGAGCCCAGCTCACCTGC |
| CCCCTCTTTTCCAGATGGGAAATGAACTCATAAGAGAACTATGGTGCCAGTGCCACTTTTTAGCTTGATA |
| CTCCCGGGGAGATCTGTTTTTTTTCCAACAACCAGCTTTCTCCCTTTCCACACTGTGCCCAGAGCAGGCG |
| AATGTAAACCAGGGTCCTAAACTTGGAGTCTGGATTGGACCCAAGAGAGGGGACTGGTGAATTTCCTGAA |
| ACTGAATGCAGGGTATTGAATGTGCAGCCTGCTCACCACCCAAAAGAATGTGTAGGTTTTAGTGGATTCT |
| TAGTAGGGTCATCACCCCTCTTCCCCAAAGAAAAACAAAACACAAAACACTGATTTTTGAAAAAATGTCC |
| CCAAATCTCATCGTAGAAGATAATTAATTACTAGAACAGAACACGGATTCTGTATTCACGTTTAGACTT |
| TTAGCTGGATGATTCTGCCATACAAGTGGGTACATTCGTCTTGGGCATTTGATTCTCACGGCAGCCTAGG |

| Sequences |
|---|
| GGGCGGACGGGAGGCATAGCTTTTGCACAGGAGAGTCCAGGGGACGGGGGTGACTTGTCAAGGTCCTACA |
| GCTTGTATTTGGGAGCAGAGATTTGCGGCTAGGTCTCTCTAATTACAAAAGGAGTTCCCTGTCCTGGAAG |
| GTTGTAGCTTCAAAGAGGAGCAACAGATAGGCGCATGGTCGCCGATTTCAGGGAAAGGAGGGGACTGGGA |
| GGGAATGAATTTGGTCAAGGGGGCGGGGGAGGATGGTTTATGAAGGTCCAAACGAGAAATCTGCTCCTTT |
| GAGGCCTTGGGGCTGAAGCACTGAAGTCCCCAGGATCTGGGATGGGAAGAGGATCTCAGGGGTCCACACT |
| GATGGGTAAATGCAGCTCTCAGCACGTGGGTGGAGAGGAAAAAGAATCATTCACTCTCTGTGCAGCCTGC |
| TTGGAGCGCTCGGAAGGCATTCCCAGGCAAATGCAGAGCCACTCTGTTAAACCCGGGTGTTTTGCCCACG |
| AGTCCTTCTTGCTGGGCTTCCCAGGAGGTGCTCTGTAAATTCAGCTTGTGTAGGCATTGGCTGACCCGCC |
| CTGGCTGTGTATCTGCCAGTCCCCAGCAGATGCCTTACCAGCACCAGGGAAAACCGGAGCCATTTCTAAA |
| GGTTCCACATGCATCTCTGGGCTGGCTCCTTCTGGAGGATGGGACCCTTGGGTGGGGTCCTGCGTGGTCC |
| TTGACGCTGGGAAGTGGGACGGTTCCCCAGGCTCATTTCAGCTCCTAGCTTTTTCTCTGCTCCTCTGGAG |
| TGCCTTTGGGGTCTCTCTAGGGCGGATGCCTGCGGAAGGTGCACAACCCCACCACCAAATTCCTGGCATC |
| CCTGCCAGCTTCAGGACGTTCCCAGCTGGGGAGAGGGGCTCGGAGCTGCTCAGAACTGCCTAGAAGCCAG |
| GCATTCCCACCCGAGACTCCGGACTTTTAATTCAGAGCCGGCTAATGAAATTAGGAGCCATTAGATCGC |
| CCTCGCGCTGATGTCTCCACACTGTCCCCAGCCGTCAAAGCAATTTGGCTAAGCCGGGCCGATGGCCCCG |
| CCGGCCGGGGACTGTGGCGGCCAGCGGGGCCCCGCTGCGTCTCTGTCGCCACGCCGCCCCGGTCGGCG |
| TCGCTATCGGCCGGGGAGGCGGCCGGGCCACGGCGGCCGGAGATTAGAGACGCGCGGCCCGGGGTCGGGC |
| AGCCGCGGGGCCCGCGAGTTCCTCGTCCCTCCCCCGCCCCGGCCGCGGCTCGCCTCCCCCAACTACCTC |
| CACTCGATCGGGGCCGGACTCCAGGGTTGGTCCAAGAATCTTGCCCCAGGGTCATCAATGCAAATAATCA |
| AAGTCACAGAGACAACCTCCGCAGTTCCCGGGAAAAAGCAGGCCAGATTTTCAGGCTGTTAAACGCGGCG |
| ATTCGCAAGTTCGGTGGGGATGTGTCAGAGCGTTCTGGTAAATACTAGCGTCATCAGAACAACAAACCCA |
| GTTTTATTGGTGAGGATGCTCATCTGTGACTAGCCCTGGCTCCAGCAAGAACGTGCAGCCTGGAAGTCCT |
| CCTCCTCCTCCTCTTCCTAATGATAATGGTGGTTGTAAAAATTACAGCACAACTACAGCAGTTAGGACCC |
| CTCTTGTCCCTGGGAACACCCCTAAATATGGGGAAGATAGGAGGTAGAAAGAGAATATTCCCGAAAAAGC |
| AGATGTAGCCGTTCTGTCTGGGGCCAAGCGTGGAGATAATTCTGGTTGTGGATCCTGAAACGTGATAAAG |
| CTGGAGAAAGGGAGTTTCCAAGGCAACCAGCCCCTTCTTTGAGGGGTGTGGGTGGTGCTTCCTCCCCACA |
| CCTTATGAGCCGACATCCTTGGAGGGCAGATCACCCGTGACCCCCAAATATCTTCTCTTTTCACGAACTC |
| TGCTTTGCTTGTTCTCCAAACAAAGGCCCCAGATTTGAGGTCTGATCACCCACCCTAAGCCTCAGAAAAA |
| GGCTGTGCAGAGAACTGGTGATTTTTTTTTTTACTTATTTCAGTTTTCCAAACACTTGATATCTTCTCTT |
| GCATCCCTTAGAGATTTGGGGAGTGGGGGTTATTTCTATGTTTGTTGTTTGTTTGTCCCCGTGCCCCTAC |
| ACCACCTGTCAATCCAAAAGTGCCCTTGAGGCTTCCCTCCAGACGCGGATTCCTCGATCCAGACTTGCTC |
| AGCTCCCGTTGGGGGTGGGAAGTGCCCTATGCAGGGAGTTAATTTATTAAGACAAACTTTATTAAGAATTC |
| TGATTTACTGCTCTGTGTGCCTTGGGTAGATTCCTGGAATATTACCCTGGCTTTTTCGGTTGGAAATTGT |
| TATTTTTGAAATGTTTCTTTTTAATGAAATCCCTGGCCCCTTTTCAAACAGAAGAAAAATATCTATTTT |
| TCGAGAGCCGATATAACAAGGCGAATTTAGAGGGCGGGGAGCAGGGTTTTATCTGGAGACAAAGGGAGTT |
| TTGATTTTCTTACAATCTCATTTTCTTTATTATTTTTAGATTATTCTAAATTCCATGCACAAATACCAGC |
| CTAGATTACACATCGTGAAAGCGGATGAAAATAATGGATTTGGCTCAAAAAATACAGCGTTCTGCACTCA |
| CGTCTTTCCTGAGACTGCGTTTATAGCAGTGACTTCCTACCAGAACCACAAGGTAAGCCTGAAGCCCAGG |
| AACCAGTGCCTGGGGCCGTCTGCTCTTTCTTTTGCATGAATCTGCAAGGTTTTCCTGCTGGAACTTTGCT |
| CCCTCTGAATGGCAGCAGTCACCAACTTCGACCCCAGGGTGCTGGGGTGGGGACAAAGCTGCAGCCTAAGA |
| GTTTCAGCTGTTTTTACTATATCCACGAGCTTGGCTTGACAGTCACCACCACACATATGCACCCACACCA |
| GTTAGAAACAAACTTGTCAAACCATAGATGGGCCACACACTCAAATACCACAAGAAGGCATCCCACTGAC |
| CTTATGAAATGCCTAGTGGGAAGAAAGGTTGCTTAATGGCTCTGGTGCTGCCATTTCATTTCTGGGCAAC |
| TGTTTCTGCTGGGGTCAGTTTTCTCCTCTCTGCCTTTTTAATATTTTTCACTCCGAGACAGGGTCTCACT |
| CTGTCTGTCACCCAGGCTGGAGTGCAGTGGCACAATCATGGCTCACTGCAGCCTTGACTTCCCAGGCTCA |
| AGAGATCCTCTTGCCTCAGCCTCTGGAGTAGCTGGGACTATAGGCACACACCATCATTATGCTCAGCCAA |
| TTTTTAACTTTTGTTTTTTGTAAAGACGGGGTCTCTCTATGTTGCCAGGACTGGTCTTGAACTCCTGGCC |
| TCAAGTGATCCTCCCACATTGGTTTTCCAAAGCGTTGGTATTACAGGCATGAGCCACTGCACCCAATTTT |
| GCCACTCAACTGGCAACAGCACAGGTGGCAAAGTTGCCGGGATCCTTAGGATTGGACTTTCCTGATGCTT |
| CCCTAATTGTTTCAGAAATCACTGACTCCAGACCACATTCTTGGGAAAGGTTTGCCTTGTTAAAATGAAA |
| ACAGAGCAACCTGCACCACCAGCAGCTTGGGATAACACTCCCAAGCTGGACTTAGACAAAGAGCCTGCAG |
| AACCACAGCTTGGTGAGGGGAGGCAGACCTGCATTGCTTGGGAGAAGGTGGCTGCAGTTTGGTGTAGGGG |
| CGGTATGCTGTCGCATGGATTGTGTGAAAGTCAGACCCCATGAGGTTCAAAATCCAGGCACTGGTTTTTG |
| CATTTCAAAGCTTGACAATGACTTTGGAGCAGGCTGCCTATAGCGGCAGGTTGGAGGGTGGGGAGGATC |
| TTCTCTTTTTCCTCAGGAGAAAGTTTGTCTCGACTTGTCAGGATTGACCTCTGTTCCTTAGATACCCGAG |
| TGCATGTGGATTCATTTTATTGTGGGTGGCAGGAGGGATTTAATGTTCTAAGCCTTGGTATGAAAAGTTC |
| TAGAATCTGGAGAGGCGAGCAATAGGTGCTGGGGAGGGGCCCCTGCCCTCGTGCGGTTGTAGACTGTTA |
| GGAGTATTAAGCAGTGATTTGGGCTTAGAAGGCTCTGGAAGGGCAAAGTGGGAGGGGGGTCCATATGGGA |
| TCTGTGAGGGCAGGTCACCTAGATGGATGTGGAGATGGTGTGCCCCTCCCTTTTCTTAGCTACAGTCCCC |
| ACCAGCAAGGCTGGGGTGGAGGGGGAACTGCAGGAGCTGGGGACTGGACAGGAGAGGCCGGAGAAGGATG |
| AGAGGAAGGCTTAGCACCCCAAATCCTCCCCTCACCCCTCGAAGGTCATTCCAGTGCAGGCTGGCTTGGC |
| AGAGAATACCCCAACTGAGGCCGGGACTGTTCCAAAATGCTGTGGCTAATCTCCAAATCCAGATTGTCTG |
| TGAACAGGCCAAGCTGTGATAGACAGTCCTTTCCAGGCCACAAAGCCTGTCTGGGAACCCAGGTCGAGAG |
| AGAGCTTCCTGCCCTCGGAAAGAAAACTCATTCCCCTCAAGACACCATTCCTTTTTAAATGGGTAGGAGG |
| ATTTTTCCGAGTATCCTTCCACCTGTTGAACCAGCAAGAGCAAAACCGAGGGTCGAATGCCCTGAAAGAT |
| GCAAAACTATTTCAGGCCAATTTGAGTCTGTCTCCTTGAAACCTGTTTCCCTCAATGGCTGCTGTAAACC |
| TGTGTTTAGCTTTGCGGTGACGGTCACAGGAAAAAAAAATAGCAATAAGGAAGCTCAATTCTTCCTATA |
| TATGTATATACTTACATGCTCTCAGACCAGACTGGGGTCAAAAATATATGAGATCTTTTCCCCCTCTAC |
| CCCAAGAAAGCCCAGGTTCATACAGGAGGATAGGAAAGGGTAGACATATAAAAGTGACCGGCTTAAAAAA |
| CCATCTGAATTCTCAGGTCCTTTGGAAGAAACACCCTAAATTCTGTGTAGTTATGTTCTTAAGACTCATC |
| AGGTGTGGATAGATGTGGGAAAACTCACTCCCTCTCTCCCTTTCTGTTGACAGCCTTATTGAGGCATA |
| ATTGTCATCTAATAAACTGCCATATTTGAAACAGAACAACTAGATAAGCTTCATGTGTATATATATGTATA |
| CCTGTGAAACTGTCACTGCAGCCATTTGTGAATATGCCCAACACCCTTTACATTGCTATTTAAAAAATTT |
| CTTCCCCAATCACGTATTTAGTGATTGATGTGCATGAATGCCTGCCTGCCCAATGGGGTGTGTATGTGT |
| GATTTTTTTTTTTTTTTTTTAGCGCAATCCAGGGAATCGTGTGTCTGAATGCTCACAGGTCTAAGA |
| ATGTGTGTCTCCAAATACGCATTTGGATATATGCGTATTTCACGGCCACACTAAGTGTTCACACACAATA |
| ATTGCTTTTTTTTCTGTATTGATTGAGTCAGGGAGCCCAGTTGAGCTGTGCATAATGTTCTGTTTAGCCA |

-continued

| Sequences |
| --- |
| GCCTGACAGATTCCTTGACATCCGGGAGAGAAATTTCATGGGAGACAACTTTCTGTTACCCTCCCCCACT |
| TCTTCCTTTAGAGCACCAAAGACACCTATTTTCTTTTTCAGGAGCAAATCCAAAACTGTGCACTTTCCCA |
| GTCAAGTGCAGGGCCCCTGCAAACATTTCCCACGTGGATATATGATGTGTGATTTAAATAAGCGGGCCAG |
| GGTTGCATGTGATTTGTGGACTCAGTCTTGCTACTTTATTGTCCCACCTGGACTGGGTGTTGAGACTTCT |
| GACTTCATGCGTAGAAGCCAGCTGAGCTCACCATCGCATAGGGTTAAGGTGGAGGACTGTGGAAGCTGAC |
| TGCTTGGGTTCAAACCTATCTGACTTTGGGCAAATGACTTAACTCCATTTCCCCACCTGTAAAATGGGGA |
| TAATAAGAGAACTCACCTCATAGTGTTGTTGTGAAGATTCAATGAGATAATTCCCGGCAAGTGTGTCATG |
| TGGGACCTGGCAGAGAGCTAGCACAGAGCATTAGTAATGATTGATGGACCATTGATTGACTACTTAGCAG |
| ATCACTTTATTAACAGGGCGACTCCATCCAAAACACAGACTTCGGAAAACTCTTTGTTTACTCATTCTAA |
| CTTCCTGGCTAGTTTAGAATCTGAAAGACTGGGAATTTAAATAAGTTCTTATTCCTGTGGTTGAAAAACA |
| ACTGCAAATATTAGTCTTTGTGGTTTAGTTGGCTCATTCCCTGATCATGTTTATCAATTCAAGGACTATTT |
| GTCTAGCGTTTTGCCTTGGATAAATGAGCAGGGAAAAGAAAAGCAATGCATGTGATTAAATTGCCAAGAC |
| AATTTGGAAAAATAAGGGCCACCGTTTTTATGGTCAAAGGGCCCAGTGCCTTCAGAATGATCTGTCTCTA |
| TTTGGATGTAGGTACCAGGTGGAGGTAGGTAGGCTACATGGTTCATTTCTTAGGCTGCAATCACATACCC |
| ATATACCACTGGGCCCCTAATGACGAGACACATTTCCTCAGCCCAGCTGTGATCTCGGGCTGGATTTGGG |
| ACTTATTTCCCCAGATGGTTGACAGCTTAAAAAAGATATTTAAAAACTCAAATCTTCCCCAGCGACGTTC |
| ATTCTGTGAAACACGTTTTTGTAAAGTTTTCACTGCAGTTGTCAGCAGCTCCCAGTGCAATCCCTAGAAA |
| TATTTAGGTGTTAAAAAAAGGTCACGTGGGCATTTCATTTCCCTGTTCTTGCAACAATGGCTGTGTATGC |
| AAGCAATGTCTATCCCCAGATATTAACTTAACTTTGCCATTAAAAGGCATTTTCCTCCTGCTTAAATCAT |
| TGTGTAAGGAGTCTATATTTATGAGGTATGAGCTTTCTGGTTCAGACCAGGAAATGAACCCTTAATAGAG |
| AGACATAATTAAGATTTTTGGTCCTCGTGAGGGTTTAAAAAATTTTTTTCAAAAGCAAGAATTCACAAC |
| AATTATTCTCATTAATTTTTACAACCTCTGTCTCAGTTGGAGCTGGTATTTATGTTTGTTTTTCCCCCAC |
| TCCCAAATCTCTCCCGGATATCCGGTTTTATGTTGATTTGAAGGGAGTACATTTGCATGGTGAATAGAA |
| GTCAGTTTCAGTGAAGCCTTTTGGTGGAACTGGGAAATCAGGTGTATCAGTTTGTGTGCCCATGATCTA |
| ACACACAGCATATTAGGAAGGGAACTTTATAAACATGGTTACAGTATGTGAGTGGACAGATATTTTGACC |
| TGCAGACAATGTATGTTGTATGTTGACATTTCTCAAGGGTAATTCTTAGGTCATATAGGCATCTATAATC |
| AGTTTCCAAAAGAAGTTACGTGTAAAGATCAACATACCTAAGTGAATATATAAGAAATTGTGCTTATCCT |
| GTGCAATCATATTTTTGCAAGCTATGATGGTAAGTGCAAGATTGGGTAACAGCCAATCTGTTTGAGGTGC |
| AAGGAATGGATTTGAGCAAAAGGTTTTTGCTGATAACATAAAATTCACCCTTTTCTTCTTTCCTTGGGGC |
| AATTTTTTGTTCTGAGTTCTTGGTGGAGCATGGACATCATGGACTGAGCACTAATTCTCATGCTGAGATC |
| CTCACTAAATTCTGGTGTCACAGCCTCACCATCTTCGACATTTACTTCTGAGACTGCGGTGGGGCAGGCT |
| GGGAGGTGGGAGGAAAAGGTGTCCTTCATCCACTTTTTTTTTTTTTTTTTTTTTTTTTTTTTTTTTTTG |
| AGACGGAGTCTCGCTCTGTCGCCCAGGCTGGAGTGCAGTGGCGGATCTCGGCTCACTGCAAGCTCCGCC |
| TCCCGGGTTCACGCCATTCTCCTGCCTCAGCCTCCCAAGTAGCTGGGACTACAGGTGCCCGCCACTACGC |
| CCGGCTAATTTTTTGTATTTTTAGTAGAGACGGGGTTTCACCGTTTTAGCCGGGATGGTCTCGATCTCCT |
| GACCTCGTGATCCGCCCGCCTCTGCCTCCCAAAGTGCTGGGATTACAGGCGTGAGCCACCGCGCCCGGCC |
| TTCATCCACTTTTAAATGATCTATTTCTCCTTAACTTTTTGCAAGTCCATTAAGAGATGATTTATGGTCA |
| ACTGGGTGAAATTTCATTGTGATAAAAGCTGAGTGAGAAAGAAAAGTCCCATTAGATGTTGGGTTTTTAG |
| ACTCTTAAAATACAAGTGAATACAGGAGTACACATCTTAAGATGACTTTCCAAAAGGATTTTATAGATTT |
| TTCTACTCATTCAGAAGAGTCAAGAAAAAATCTGAGGCCAAGCGTGGTGGCTCATGCCTGTAATCCTAGC |
| ACTTTGGGAGGCCGAGGTGGGTGGATCATTTGAGGCCAGGAGTTCAAGAGCCAGCCTGGCCAACATGGTGA |
| AACCCTGTCTGTACTAAAATACAAAAATTAGCCAGGTGTGTTGGTGGGCACCTGTCATCTCAGCTACTCG |
| GGAGGCTGAGGCAGGAGAGTCACTTGAACCTGAGAGGCGGAGTTTGCAGTGAGCCAAGATCGCGCCACTG |
| CACCCCAGCCTGGGTGACAGAGTGAGACTCTGTTTCAAAAAATAAAATATAAATAAAAAATCTGAAAGCT |
| ACAGGAATAGACACAGTTAAACAAAAATGGGCTGGGTGTGGTGGCTCACACCTTAATCCTAACAATTTGG |
| GAGGCCAAGAGCTGGAGGATTGCTTGAGCCCAGGAGTTCAAGACCAGCCTGGGCAACATAGTGAGACTCT |
| GTCACTCCGAAAACCTAAAAAAAAAAAAAAAAGGTTGAGGGAGGGAGAATGTGTACACACACACACACA |
| CACACACACACACACACACACACACACACACGGATACTTTAAAAATATTTTAAAATAAACTTTAGGGTAGGAAT |
| AGTGGCTCATGTGTATAATCTCAGCACTTTGGAAGGCCAAGGTGGGAGGATCACTCCAGCTTGGGAGGTC |
| AATGTTGTAGTGAGCTATGGTCACTCCACTGCACTCCAGCCTGGGTAACAGAGTGAGACCCTGTCTCAAA |
| ATAAGTAAATAAATAATTTTTAAAATACTTGGCTCAGCTGGGCATGGTGGCTCACGCCTGTAATCCCAG |
| CAGTTTGGGAGGCTGAGGCAGGCAGATCACCTGAGATCAGGAGTTTGAGACCAGCCTGGCCAACATGTTA |
| AAACCCTTCTCTGCTAAAACTACAAAAATTACTCAGGCGTGGTGGCACATGTAATCCCAACTACTTT |
| GGGAGGCTGAGACACGAGAATTGCTTGAACCTGGGAGGTGGAGGTTGCAGTGAGCCGAGATCGTGCCAGT |
| GCACTCCAGCCTGAGTGACAGAGTGAGACTCCGTCTCAAAAAACCATAACAACAACAAAAAACCTGGCTG |
| GGCACAGTGGCTCAGCCTGTAATCCCTGTACTTTGGGAGGCCAAGGCAGGAGGATTGCTTGAGCTCAGGA |
| GTTCCAGACCAGCCTGGACAACATGGCAAAACCTCATCTGAACTGAACTAAAAATAAAAAATAAAAAAAT |
| TAGCCCAGCATGGTGGTCATGCCTGTGGTCCCAGCTGCTCGGGATGCCGAGGCAGGAGGATTGCATGAG |
| CCCAGGAGTTTGAGGCTGCAGTGAGCTATGTTCGCACTGCAGCACTCCAGCCTGGGTGATAGATTGAGAC |
| CCCATATCCAAACAAAACAAAAAGGCTTCATTTTTTAGAGCAGTTTTAGTTTCACAGCAAAGTTGTGCAG |
| AACATACCAAGATTTCCCCTATAGCTTCTCCCCACCACATGCACAGCACCCCCACCATGGACATCCTGT |
| ACCAGAGTGGAACATTTTTGCAGTTGATGAGCCTACACTGACACATCATCATCACCCAGAGTCCATAGT |
| TCACCTTAGGGCCCACTCTTGGTGTTGTACATTCCATGGGTTTGACAAATACATAATGATGTGTACCTG |
| CCTTTATAGTATCATAGGGAGTAGTTTCACAAACCCAAAAATCCTCTGGGCTCTGCCTATTCATCCCTCC |
| CTCTTTCCAACCTGTGGCCACCACTGACCTTTTAACTGACTCCGTAGTTTTGCTTTTTCTAGAGTGTTGT |
| ATAGTTGGAATCATATATCTTAAAATATTAATTGTATGTATATTTTTTATGGTGAATACACATAGGTGCA |
| CATACATATAATAATTTTATTTTCAATAATTTTGGGGTTAGAGGTAAACCTCATAGGTCATCTCTTCCAG |
| AAGGCAGAATAGATAAGAATTCCTCTCTTCAAATGAAGAAATTAGAGGGTACATTCATTTATCAAGCACA |
| GTTTCTCAAATCTGTAACTATACTACTGGGAAAGACTCGAGATGATTTTAGGGATACTTGAATATGATG |
| AAATCAGAGAGAAAGTGTTTTTGTTTGTTGTTTTTTGTTTTTGTTTTTTTTGAGACGGAATTTT |
| GCTCTGTTGCCCAAGCTAGAGTACAGTGGTGTGATCTCGGCTCACTGCAATCTCTGCCGCCTGGGTTCAA |
| GTGATTCACCTGCCTTAGCCTCTGGAGTAGCTGGGATTATAGGAGCCTGCCATCATGCCAGGCTATTTTT |
| TTTTTTAAATTTTGTATTTTTGTAGAGATGGGGTTTTACCATGTTGGCCAGGCTGGTCTTGAACTTCTG |
| ATCTCAAGTTATCCACCCACCTTGGCTTCCCAAAGTGCTGGGATTACAGGCATGAGCCACCATGGCTGGC |
| TGAAAGTTGTTCTTTTTAAAATTATCTTTCTAGTCTTCTATTAGAGGGGAGTCTCAGTTCAGTACTGGT |
| TTGTGTTAACTAGTTCTCTAAAAGTGTCTAATTTCCACTTGCAACAAAGAGAAGGCAAGCTTTGGATATG |
| AGTAAAGACAATTACATATATTTATTTTCTTCTTATTGAGTAGCAAGTGATTCTAGTTTGTCATACAAAG |

| Sequences |
| --- |
| AAGTGATATCATATTTGTGTGAAATAAGTGCAAATTAAAAGTGGTTTGATTTAAATAAAAATATTAAGCC
AGTGTACAGGTGCTGTATAGATATGGCAATAATAGTGAAAGAAAACCTTGAATGACTGAAGTTTGAGTCA
TGCTGCTCTCATGTCTATAACATGATTCTCTATGTTCTCTATGAAAATTCAGTTCACACGCAATTTTTAG
GAAATACTTCTGGCAAACTCCGTATGGTTGCCTTCTGTCACCTGGGTCTGCTACTGTACATTCACACTAA
TATAATGCGTTGATGGATTAAATTAAAGTTCTGGGCCTGGAACCAAAACGTGCAAAAAGACCCTGTTCTG
TAACTATGCCTTGTATGTTGCAACACAGATTTCCAAGAGAGAAACCTCTCTTCTTTGCTTAGGACATTAA
AGAGGTTTGGTGCTGTTCAATAGCTATTATATAAGTTATCATTATGTATATTGGCGTTTATTTCATTAGG
CACCATTTTCCACCAGAACTAGGAAACGCTATCTGCAAAACTATGAAATGAACATGAAATGAGGCATAAT
AGAATTTTTGAATGCAATAATCAAGACATGTTTTCTGCAGAAACACACGATGGGGTCAACCCTTCCAATG
GAGATGACTACGCTGCCTGATGTGCAACGATCATGTCAACATGCACAGCTTTCCAAAGGGGAGGGAGTAC
TGAGTATTGAGGCCTAGATGGTGTTTAAAACACAAAATGCAAGATTGGAAAAAAAAAAAAAAGAACCCAG
CTGGAATGATGCAGAGTATGACTCCAATTAATGGGCAAACAAACCCAGGTGTTTTTCCCCTTTTAAAAG
CAGTCCAATGGAGGACATTTTTCAAAGCCTCCACTTGAATGAAGTGGTGGGTCCCGTTGACGTGACTGGC
TTAATTTGCTTCTTTTGGTTGCCAGAGGCTGCATTTCCATGATATTTATTATTAGCTCATGTCCTGAGGT
GGTCTTGCAGCAATCAAGTGAAAACCAGCTTGTTCTCTCTTCCTCTTTCCTTCAGATCACGCAATTAAAG
ATTGAGAATAATCCCTTTGCCAAAGGATTTCGGGGCAGTGATGACATGGAGCTGCACAGAATGTCAAGAA
TGCAAAGGTAGGAAAGTGGATTCCTCAACTTTCTCCTCCCCACATACCCCTCAAATTACCCAGGTAAGCC
AGCAGCAACCCAGCACCTCCCTCCACCAGCCTTCCTGCCCGTAGAATGCCAGGCACATGGAAATGGGGAG
AATGAGCCCCCTCTGTCCCATTTTCTGATAACCTTCACATGTGGTTGGCGCCATTGGGCAACCTGGAGAA
TACATTTTCTAGTGGAGAGAAGGTACGAAGAGTTCGGCATTCTCCATTCTCCCAGGGAACAAAAGGCACA
GCTTTCTCTTCTTTCTCTGCTGTCTCTCTCCCTGTAGGGAAACCCTTTCTCTTTTTCTTCCCATAAGTCA
CAGCCGATGAATGCTTTTTTTTTTTTGGCAACAGCTCTTGGTAAATGAAAGAAGTTAATGACTTGA
TTTCCTGAGGGTGAAATACAGACAAACTTGACACCATGTGGTGTCCAGGGCACTGGAGGATTGGAAGCTG
GTGCTAAAAATTGCTCGGTATTTTACATATCCTGTGGTCATAGTTGCTGATATGATGAATAGAACGGGC
TGTAGCAAATGTACATAGTGGGAATTTGGTCTGATTTGAAAGGATTGTACAAGCATTGCCAATTTTGTGG
AACATTCTCTCTACCTCTTGATGTGCTTCCAAAATAACTTACCATATGGCAAGCGAATTAGAAATACATC
TTGATCCCTCTGACCAAGAAGGTTTGTGTGTGTGTGTTGTGTGTGTGTGTGTGTGTGTGTGTGTGTGTTT
TCTTTTTTTCTGTTTGGTGGGTTTAGTGTTTCAAAATAAAATGAGATCCTTTTGGATGTTTTCCTTATCC
TTTCTGGAAGATGTGAAAAGGGAGAGTCAGGCAGATAGACAGATATATTCATTCAAAGAAAAGATAAGAGA
CCTAAGAACATAAAGGGAGAAAGACCTTAAATCTGTGGTTTTAATATTAGGTTTAGAAATACATGCAATG
GAAAAATTGTTTTTAGATAGCGGGCTTATCAGGTCAAATTTTGCAAGCTTTTTAAAAAATAATGCTAGCC
CAGGTGGCATGTTCCTGCAGCCCCAGCTACTCAGAAGGCCAGGCAGGAGGATTTCTTGAACCCAGGAAT
TTGAGGCTGCAGTGAGCTATGATCACACTACTGCACTGCAGTTGGGACAACATAGCAAGACCCTGTCTCC
AAATATTAAAAAAAAAAACAAGAGAATGACCCTGTTTCCAAACATTAAAAAAACAAGGAGTGTGGTACA
TCTGTGCACACATTCCTGTTTTCATAAATTGGTTTCCTTCAAGATTGTGGACTCACAAGGTACTTTTTGT
GGCTAAAATAGGCAAGTTCTGAGTTTGTTATTTAAAATTTATTTTTGGTTTTAAGCATCTACATTTTGAA
ATTGATTGGGCATAGGGTCAGTGGAAAAGATGACAACAAATATCATGTTTTAGCTGAAAGAGGTTCAAT
AATTCACGGCCCTGGGCTCAGAGTGCCAACTTTCTGTTCCTATCCCATTCTGATGGTGATTTGCCGTTAA
GGTGGCTTAGTCATTGCCACACAAAGTCACCTCTCAGTCCTACAGGCAAAGTTCCTGCTGTGCAGGTGGG
AGCTGAAGGGAGTCACCCATTCCCACCTGCAATCAAAGGGTTTCATCATCTCTTACTTCTTCCCTCCTT
TTTACAAGGTCAAGGGCAGGGGGTGAATAATAGATTTAAGGTGTGTTGAATCATCCCTTCAAACTTTACC
AGTTACCACCTCCTACTGATTATACCTTCCAGCATAACTCGGAATTCAGCCCCCTTCTGCCAGGGTGCTA
ATTCTAGCCACCACCAGCCTCCTAACTAATGGAGACCCAAATTCAGTTCTGGTCTCCTCCAGGGACTTTC
TTTAGGCAGCCACCAAAGAGATCTTTGTAAAACACAAATCAGGCAAGTTCTCTTTGCAGTGGAGAACATG
TCCAAGTCTCCTGTTGCCATCACTATAAGGTTTGGACTCTTTTGCCTGGTTAGCCATGACCTTCCCATCT
GGCCTGGCCACCCCCCTAGGTTTGTCCTTCACCAGTGTCCCCCTAATATGTGTCAATCATGCTAAAGGAA
AGGCTTCAAACCTGTGTTCTTTCCTTTATTTTTGGCCCTTCGAACACACATTTCGTCTGTGTCAAACTCT
TTTCCCTCCTTCTCACCAGGCCATCTCCCAACCATCACTGAGTCTCCTTGTAGCTTTTCCTTCCTTCAAG
AAGCTTTCCCTGGCCATAGACTGTGTGGTCAGCCCATGTCTCCCCCAGGACCCCTCCTGGGAATCAGCCC
CTCAAACTTTACCAGTTGCCCTCCAGGCTTTTCTGTGTCCGACCCAGGCCTGGAACTTTGGAAGATGATT
GGACAGATGACAGCCAGCTATGAAAGTAGAGACAGGTGGGCATGTGCAGGTGTGTGAGAGCTCAGATGTC
AGATGTCAGTCATCAAGGGAGTCTTTTCTAAAAGCTCTTTTTTTTTTTTTTGGAGACAGGGTCTCA
CTCTGTCGCTCAGGCTGGAGTGCAGTGGCACGATCTCAGGTCTCTGGTTGCTGCAGCCCTGACATCCACAGGCTCAG
ATGATCCTCCCACCTCCCAAGTACCTGGGACTGCAGGCATGCACTGCCATACCCAACTAAATTTGTATGT
TTTTATTTTATTATTACTTTTTTGAGGCGGAATCTCCCTCTGTCATCCAGGCTGGAGTGCAGTGGCA
CGATCTCCGCTCACTGCAACCTTGGCCTCCCGGGTTCAAGAGAGTCTCCTCCCTCAGCCTCCTGAGTAGC
TGGAATTACAGGCGTTCACCACCACGCCTGGCTAATTTTCGTGTTTTAGTAGAGACGGAGTTTCACCATGT
TGGCCAGGCTGGTCTCAAACTCCTGACCTCAGGCAATCCACCCGCCTCGGCCTCCCAAAGTGCTGGGATT
ACAGGCGTGAGCCACCACGCCTAGCCTAAATTTGTATTTTTTGTAGAGACAGGGTTTCACCATGCTGCCT
AGGCTGGCCTAGAACCCCTGGACTCAAGTGATCTACCTGCCTCAGGCTCCCAAAGTGCTGGGATTACAGA
CATTACCCACAGCCCCTGGCCAACTCTCCTAAAGTTCTAAACACATGTTCATTTGTTTGTGTACTTACTT
ATTGATTGATTGATTGAGACAGGGCCTCGCTCTGTTGCCCAGGCTGGAGGGCAGTGGTCGGATCAT
GACTCACTGCAGCCTCAACCTTCCAGGCTCAGGTGGTCTTCTGGCTTCAGCCTCCCAAGGAGCTGGGTGT
CCAGGCACACAGCACCGCATCCAGCTAATTTTTGTATTTTTGTAGAGGCAGGATCTCCCCAGGTTGCCCA
GGCTGGTCACACAACTGTTTATATATTTAGGCAGATGACTCTTCTTTGGCCTGAATTGGCTGTCCTAACC
ATCTGTCAAGGTATTGCAGATTGCTTGAGGCCTGGACTAGGTGTCCTTGATGGGTAGGAACTTTGCAGAT
GGAATGGAGGAAAAGTGTGGCTAGTCATTGGTAGAAAGTCAGTAATTGACATGTTGAGTCAAACCTCTCA
GCCTAAGAGCCATGTGTGTCTTTGTGGCCATGTTAGCAGTTGCCCTGGAAACCAGAGGGCTGAACTAACC
ACTGATGAAGTTGGGGGAGTAGATGAGGTCATTGGCCAAGGTCTCTGGACATGTCCTTGGGGAAGGAGAA
AGAGTGAAGAAGAGTGGTTCCCACAGAAGGCTTTGGAGTCAGACAAACCTGGGGTCAATTCTTGTTCTAC
ATTTATCAGTATGAGCCCTGGGGTAAGTGATTTAACCTCATGGAACCTCAGTATTCTCATCTGCAGGAGG
GGCATAGATAAGTATAGCCTCTACTTTCTAGGGTTCCTGTAAAAATTATATGAGCAAATGCCTATAGAGT
GCTTGATTCCTAGTCTATATGTTCAGTAAAATTTAACTAATTTGGAGGAAAGCTCCCCAGTACTCCCAAT
TTTGCCCTTGTTCAGAATTTATTTTGGGTCATTCTCCCAACCCCCAGGTTGCAGTCAGTAGTGACAAGTG
GGGAATATGGCTCTCCAGAGTCAGCCTTGATAACAGCCAGGCAGGAACGGCAGGCTCACTGCTAATCTTG
TAATTCTGTTTCCTGTCCCCTACACACCCGGTGACAGCTGGCTATGGGAGAAAGCAGGAGGGATGAAAT
ATCCTCTAATTCCAACAATTGGTAGAAGGGAGTGAGGTGGGATTACAGAGAGTTAAGCATTACCTTGCAC |

Sequences

```
TTATTCCACAGAAATAACTTTTGGATTTGCTTGGCAAATGTCTGGCTGTTCCCCCATCTACCTCTTGGCC
CAACTCCCTGTGTTTGGAAAACGCAGATGATGTCTTCTTTATTTTCCAACATTTTTTAATGGTTTCTAGT
TACAGGAGCAATCACTGCTTATTATAAAAATTTGGGAGCTATGGGAAAGCACAAAGCATAAAGTCATTTA
AACATCCTGTCTCAAGCAGACCAATTAAAGGGTGTGCCAAGTTTATTTAGAAAGGTTAATCAATCTGTGT
CTTAAAAAAAATCTAATCCTAAAAACTAATATTTCCCCAAATTGAAGAACCCTTAGATTGGTGACAAAGG
AGTTTTTTTTTAATAAAAACTATTTATTTATTTAGGACAGGGTCTTTCCCTGCCATCCAGGCTGGCATG
AAGTGGCACAATCATAGCTCACTGCAGCCTCGAACTCCTGAGCTCCAGCAATCCTCCTGCCTTAGCGTCT
GAAGTAGCTGGACTACAGGTGCATACCACCATGCCCAGCTAATTTTTTGTAGCGACGGAATCTCACTATG
TTGCCCAGGTTGGTTTCAAACTCCTGGTCTCAAGCAATCCTCATGTCCTGGCCTTCTAAATCATGGGAAT
TAGAGGTTTTAGATGGTGCACAGACCCATGGACACATCAGTCCTGTGATTTCATAGATGTTATTGCTCAG
AATGAGACTGAGTTCTAAGAAAGGAAGAAAAGAAGGAAGCAAGGAAGGGAGGGGAGTTAAGGCTGATTAA
AGAGGAAATATTAACTGAATAGCAGAACGGCTCGTATCAAGGTTTGGGGAACATTGTCAAGATAATATGC
AAAGCACAGAAATTTGAGAAACACACATAAAAGCTCAACCACCTACAAAGAAAGGCTTGAGAGTGCCATT
GCTGTTTGAAACCATCTAGGCCCTGGTTTTTTATAGAACAACTCTTTCTTTGGACTTTGCTTCAGTCTTC
AAGATGTATTCAAACAAGTTCTGAACTTCCTAGGAGCCAAAGGGGCTGGAGCTGGGACTGGGGCAGAGTA
GGCTTTATGGAGAGGGTAAAAGTAGACCTCGTAGAGAGAATGGGACCTGAATCTGTTGGGAAGAAGGGTT
TTCTGGGCTGAAGCAAGGAAGAAGTGGGCAAGGGTCTAAAAGTCTAGGGGGCTGGAGTAGGGGTCAGATT
CTGAAGATCTCTGAAAGCCAGCTGGAGTGACTCTATGACAGGTATGAGGAGAGCTGCTCCTAGAAGTGTG
GAATTGTAGAGATAGAAGGGATTCCAGGAGACAGCATCTGATCCACCTGCTCTCTTTTGCAGAATGGGAA
ACTGAGGCCCAGAGACTCATTTACTTATTCAGCTTTTGATCTGTTGATTTGTTTATGCAACTAAAACATT
TGTTAAGTGTTTGCTGTATGCCAAGCACTAGGCATACAAGGATGAATCAACACACAGGGGACCAGGGTCC
ATGGATGGAAACAGGCCCAGGAGCTGGGTCCAGGCTGCCGCGCTGAGCAGCTCCAGGGCTTTTCTACTC
GACCGAGGAGTGTCTGTTTCCTCATCTGTAAAAAGGAAGTCATTACAGAGCCTACCTCCAGGCCTGTTGC
AAGGATGAAATGAGGTAACGTGTGTGTACTGATTATTATTGCTGCATAACAAATGACTTCCCAAGCTTAAG
CTGGGCTGGCTGGGACAACCTGGCTTCCAAACTATCCCATCTGTTCTCTGTGTGTGATGTTAAATCCAGG
CCAGCCAAAGTGGCTCACCTGCGACAACTTTCCCCAACAACACATTGGGAGTCTTCTAGCAGAGGAAGGA
AGTATACACTTCCACAAAGAGCTCCCAGACCATCAAAGTCCCCAAGTTCCCTACAGTTGCAATCTGCTAG
CCCCCAGTAATGTCCCATAAATGCTGCTTGTGGTGAAAAGACCAGGCCTTTGCTGGTCGCCGTTGTGTGC
AAGGGGAAGCAGGAAGCACCAGGGAGGCACTTTTATTTTGTCTGTGATTGGTGGGTCATGCTATTTGGAA
GGACTCAGCTGTGCAGTTCTTGCTGACCATCAGATGGTGGCTGGGCTACCGGTAACGGAAGGCAGGTCAG
GCAGGATGTCCAGCTTGGCACACTCCTGTGACCCACAGTTGATGCTGCTTTTGGATGGGACCTCAGCTGT
TGTCCACTGAAAAATCAGAATGTGGCCTCTCTAGCTTGGCAGACTCAGGGTGTTCAGACTTTCTCACGGA
AGTGGAAGCCACCTGGTCCTTGCTGACTGCACCTTGGATGTCAGGTAGTGTGACTTCTGCTGCATTCTTT
TGGTTGAATGTGACTCACTCAGGTGGGTTCAGATTCAGGGAGTTTGAGACCAGCCTGGACAACATGGTGA
AACCCCGTCTCTACTAAAAATACAAAAAATTAGCTGGGTGTGGTGGTGCTCACCTGTAATCCCAGCTACT
TGGGAGGTCTGAGGTGGGAGCATTGCTTGAACCCCAGAGGTAGAGGTTGCAGTGAGCCGAGATCGTGCCAC
TGCACTCCAGCCTGGGCAACAAGAGTGAAACTCCGTCTCGAAAAAAACAAAACAAAACAAAACAAAACAAA
ACAGAAAACAGGTTCAAGAAGGGAGGACAAGTTCTCTCTTCTACCTAGAAGGAGTGTCAAGGAATTCGTC
GACGCATTTTAAAACTGCCTCAGCAGGCATGGAAGCACACAGCACAGTGTCTGGCCCAGAGGGACGCTCG
ATCGCTGGTAGGTGTTAAGACACGGTCCATGTTCTGTTGAAGCCAGATGCCAGGTTGACTTGCCCAAGGT
CACACAGTTTGGATGAAGGGGCCTGCCTGGCTGCAAGCTTGCTTTCTTCAGGATGGGAGAGAACCCCCTTT
CCACTAAACTGGGCTTCTGCTCATCTTCTTGTAACCATAAACCCCAGAATATGAACAAGCAATAGCAAAG
TCCTTCATCTCGGTATTTCTTAGCTCACCTCACACAGAATGACCATGAGCAATGACTGGTCTTTTCACCA
TAAGAAGTATTTATGGAGCATTATCAGGGGCTAAGTAGATGATGGATTGGGGGACTTGGTTGGCCTCAGA
GTTCTTCATGGAAGAAATGAAGCTCCCTTTACTTCCTTGCTCTGTTAGTGTGCTGCAGACGGCATCAGGG
GCGTGGTCCCTGAACCTAAGGGGTAACTTGAGGCTCTACTTTTGGTGACTGGGATCTGAGCCACCCAACC
AGAGAGTGGATGGGAAAGTTTGGAGTCCAGGATGTCTCAGCCAGACTGAAGCCCACCCATGACTCAGCTC
CAGTTTGATTATTGAAAGGACTCTACACAGCCACATTGGGAACTGACCAACCTCACCCGCCTCTGTGGGT
GCTTATTTTTACCCTCTCTACCTTGTTCCTGTAGGGTAGGGCTTCTGAAAATGGGTGCAAGACTCCTTTT
GAAAATCTAGTTAAAGCAAGAGACCCTCTGAAAGACTCACAATATATGAATAGAGAAAAAAAGTCGCTAG
GTGTGGTGGCTCATGTGTGTAATCTCAGCACTTTGGGAGGCTGAGACAGGAGGAGAATTGCTTGAGATCA
GGAGTTTGAGACCAGCCAGAGCAACGTAGGAAGATCCTGTCTCTAAAAAAAAAGAAAAAGAAAAAGATAA
AAAAAAAAAAAAGATTAACTGGACATGATAGCCTGTGTCTATAGTTGCAGTTACTCTTTTGGCTGAGAC
AGGAGGATTGCTTGAGCCCAGGAGTTTGAGGCAGCAGTGAGCTGTGATTATGCCACTGCATTCCAGCCTG
AGCAACAGAGCAAAATGCTGTCTCAATTAAAAAAATTCAATTTCAAGGGATGTATAAGGCCTAGGTCTCC
TAAAAGGTTAAAATTCTTCTATTTGAACCTTCCCTCTTCTATTACTTCCTTCCTGATTTTAAATTAATTT
TCAGCTCTTAACCTCAAATGATCATTTTTCAAACTGAAGGCTTAGCACTCTTGTGTTCTCATGCTTGTGG
TTAAAGGTAATCTGAATGCCCAATTAATGAGAAGTGGTTTTCGAGACAACATTAGACAACCTTCTGGAGA
TGGCATTAACTCCCCTCTTAGGGTTGTAATTTACCTAGCCACATGGCTTCCTCCAGGGAAGCAGTGCATT
TATGTAAACAAGAGCGGGGTTGTGTCTGGGGAGCTGAGCCAGCCTAAGTGAAGCTGTAAAATTGAGATG
TTTTTCTGAAAGGATCTCATCTTGGGTCATGGTTATTTGTCAAGGATGGATGCTCAGAACCCAACCCCG
CCACATTCCCACTTTCCCACTCAGGTACCCCCACCCCCACCTAACCCATCCCCAGCATATCTGCTATTCA
GGAACAGGGTTGGGAGAAACTCACTCACCCATCTGTGTTTTCCTCATCTTTAATGAGGTATAATTGACA
AAAAGTGTATATACTTAGGTTATACAACTTAATAGTTTAATATACGTAAATGTGAGATAATTACCATAAT
CAAGCTAATTAACATATTCAGCACCTCATATAGTTACCATTTTATTTTCTTGTGTATATATATTTTAA
TATATATATATAAATATTTAAGATGTACCCTCTTAGTTAATTTTAAGTACACAATACTGTGCTCTTAACT
GTATTCACATTGCTGTACGTTAGCTCTCCAGGAATTATGCCTCTTGAATAACTGCCTCTTGAATAACAAA
TGCCTTTGACCTATATCTCCCCATTGCCCTTCTCCCCAGCTACTGGCAACCACCATTCTCCTCTCCACTG
CTACAGGTTTGACTATTTTAGATTACACCTATAAGTGAGTCATGTCATGTTGATCTTTCTGTGTCCGGCT
TGTTTCACTTAACAATGTCCTCCAGGTTCATTCATGTTGTCTCAAACGAGAGGATTTCCTTCTTTATTTT
TAAGGCTGAATAGTATTCTAGTGTGTGTGTGTGTGTATATATATACACCACATTTTCTTTATCCAT
TCATCCACTCATGGATACTCAGGTCGATTCCATATGTTGGCTCTTTTGAATCGTGCTGCAATGATCATGG
GAGTGTAGATATCTCTTTAAGATACTGATTTCATTTCCTTTGGGTGTATATCTAGAAGAGGGATATACAT
ATATCCCTGGGTCATATGAGAGTTCTATTTTTCTGTTATTTATATATTGTTTTGTTTTGAGATAAGGTCT
TACTCTGTTGCCCAGGCTGGAGTGCAGTGTCATGATCAGGGCTCATTACAGCTTCCACTTCCTGGGTTCA
AGCAATCCTCCCACCTCAGCCATCCAAGTAGCTGGGACTACAGGCACGTGCCACCATGCCTTGTTAATGT
TTTTCAATTTCAGTAGAGACAAGACCTTGCTATGTTGCTCAGGCTAGTCTTGAACTCCTGAGCTCAAGTG
```

-continued

Sequences

```
ATCCTCCTGCCTTGGCCTCCCAAAGTGCTGGGATGACAGAACGTGGGCCACTGCACCTGGCTGATAGTTC
TATTTTTAATTTTTTTGGGAACCTCCATACTGTGTTCCATGGTGGCCGCACCAACTTGCATTCCCACCAG
CAGTGTGCAAGGATTCCTTTTTCTCCACATCCTTGCCAACATTTGTTATCTTTTGTCTTTTTGAGAATAG
CCATCCTAACAGGTGTAAGGTGATATATCTCATGTGGCTTTGATTTGTATTTCCTCAATGAGTAATGAAG
TTGTACATTTTTATTATACCTCTTATCTATTTGTATGTCTTCTTTTGAGAAATGTCTATTCAGGTCTTTT
GCCCATTTTTTAATGGGATTTTTTTCACCACTATTGAGTTGAGTTCATCCACAATTGAGCAGTGTTTCTC
AAACTTTTGGTAGACATCACAATTACCTGGGGGGCTTGTTAAAAAAGATTTCTAGGTCTCACTCTCAGAG
GTTTGAGTCAGTGGCTTCAGGGATGGGTCAGAAACTGCCCTTCAACAGTTTTCTCCAGTGGCTCTGATGG
AGGTGTCCCTGGTCACACTTGGGTAATCCCTTGGTTCTAGAGAATGAGTGAGCACTAGAGAATGCAGAT
GAACACGTGATTGTATTCTGCAAACAAAGCCCATGTATGGGCCATTTTACACAAAAGGCAACCCTTTTC
TCTACTTAGTACTCAACTCACACTGAACATTAGAATTACCTGTAGTCCTCCCCTCAGTGTTCTATTATGA
AAAATCGAAGGCGTGTGAGAAACATGGAAGAATTGTACGATGAGTGCCCATGTACTCACTGCTTAGAGTC
TACAATTAAAATTTTGCTATATATTTGCTCTACCACATATCCCTCCATCCACTCACCTATCCATCCATTC
ATCTAGCCATCCTTCCGTCCCTCTCTCCCTCCCTCCTTCTTTTTATTGATGCATTTCAAATTAAATTGCA
GACATGAGTACATTTTACCCCAAACACTACAGTGTGCACATCATTAACTAGGACTCAATTTTTGTTCACA
CTCCTGTATTTTAGGTTGAATTTATATAGGGTGAAATGTACAAATGTTAAGTACACCTCTCACTGTTTGG
CACATGCACATACCTGTGAAACCCAAGCCCCTATCCAAATATAGAACATTCCCATCACCCCAGAAAATTC
TCTCATTTCCTGCCCCCTTGTCACTCCCTGCCTCCTTCTCTTCACCAGAGGCAATCAATGTCCTGACTTT
TTTCACTATAGGTTAGTTTTGTCTGTTATAGAATTTCATATAAATAGGATCATCCAGTGTATACTCTTTG
TGGAAGACTTCTTTCTCCTGGGAAGCTTTTAAAAACTCCCAGTGTCCATGCTGTTCCCCAGAACTATAAC
ATCAAATTCCCTGGGGGTGAGTTTGGGTGTCAACATATCTATTTTTAATTTCCCAGGTGATTATGGTATG
CAGCCAAGCTTGAAACCAACTCCCCTAGAGGAAGTTCCTCGTCTTTGTCCATCCCCACCCTAAGCCGTGT
CCCCCAATCACCCAACTCCACTAATTAACATCCTCACATTAAAATTTTATTTTCCAAGAGACCTGCTACC
TTGTAGTTGTTCTGAACAGGGAAGGAGGCAGACTTTTATATTGACAGAAAACATTTATCATTCCTTCA
GAAATAGTTGCTTTGGGTGACTTTGCCAAGGTCATCCTCAGAAGCGAAGGTCACCAGGAAGTCCTTGGCT
TACTTCTGGATCATCAGTGGCCTCCAGATGATTTTCCCCAGAACAAAGGATGCCCCAAGGCAATCCCTTT
GGTACAGAAAGCAGTTTGAGAAAGCTGTAGCATTCCAGCTTCCAGAAGGATTGAGGCCTTGGAGGACTCC
TTCTCACCACCCTACCCCTGTTCCAAAATCATGTAAAAGAAAAGACTAAACCTAAGTCATAGTTAAGCTG
GTTTAAATGGTTAATTTACAAGACTGGACTAAAATATTGGCTGTTCAGTTCAGTACTAGACTATTTGATG
AATTATTACCATAAATTCATTAAAAGTTTAGCTTGAGGCTGGGTGCGGTGGCTCATGCCTATAATCCTAG
CACTTTGGGAGGCCGAGGTGGGCGGATCACAAGGTCAGGAGTTTGAGACCAGCCTGGCCAACATGGTGAA
ACCCCGCCTCTTCTAAAAATACAAAAATTAGCTGGGCATGATGGTGGGTGCTTGCAGTCCCAGCTACTTG
GGAGGCTGAGGCAGGAGAATCGCTTGAACCTGAGAGGCAGAGGTTGCAGTGAGCTGAGATTGCACCATTG
CACTCCAGCCTGGGCGACAGAGCGAGACTGTCTCAAAAACAAACACAAACAAACAAACTTTAGCTTGAAT
TGTCCTTTTATGTCTGTAGTTTTACAAAGTTTAGCTTGAATTGTCCTTTGTTGTCTGTAGTTTTACATCT
AGCTTTTACCCGCAGAATCCACACCTGCCCTGTGAGATAGGCCTCTTGTTCTCCGTTATGCAAACAGGGA
AACTGAGACAAAGGGTAATGTCATGAATTGCCCAGGACTTTTCTCCATGATTTCCGAACCATCTCTATAG
TTTGAGTCAAAACCGTTTTTTGAATCACAGACCCTTTTTGAGTAGCCAATGCAAATGTGAACCTCTTCCT
AGAAAAAGTGATCAGCTCTAAATATTTGACATTTTTGGGTATTCATACCCATTTGAAGCCCTTGCTGGGT
AAGAACCTCTGCTCCAAAATATAATAATGTATATTTACAAAATAGTGTTTATTGAGCAATGTGTCCCCAG
TGTGTGTGTGTGTGTGTGTGTGTGTGTGTGTGTGTGTGTATATATATATTCGCTAAGCCTTTCCAT
GCATCATTTCATTTTATAACCCCAAAGAGGTGGCTATTTTATTATCCCCATTTTATAGACAGAAGACTGA
GGCTTGGGTAAAGGAAGAAACTAGCCAGCAATGGAGTGGTCTAGTTCGTGCCTGGATACTGAAGGAAGGC
ACATTCACCTGGCCTGACATCGGAGCCTGAGCTTGATGCTACCACTCTGATACTATATTATCTACAGATT
TAACAAGTGGGACCCAAGGCCCCAAACCAAAATTTTTACAAGTGGTGGGTACTTAAGGCCAGGGAGAGAA
GTGCCTTTGAGTTTCTTGGCACCCCTCAAATCATATAGCCCTGGTTGAGTCAACAATGGGAAATTTAGGC
CTTATAAGGTGGCTCATGTCTATTATCCCAGTGCTTTGGGAGGCAGAGGGAGGATCACTTGAGGCCAGA
TCAAAACCAACCTGGGCAATATAGCAAGACCCCATCTCTAAAAAAAAAAAAAAATACAACTATTGGCTGGG
TGTGGTGGCACATGCCTACAGTTCCAGCTACCTGGGAGGCTGAAGCAGGAGGACCCCTTGAGCCCAGGAG
CCTGAAGTCACCGTGAGCTATGTTCATGCCACCTCACTCCAGCCTGGACAACAGAGTGAGAGTTTGTCTT
AAAAACAAAGAAAAAACCGACAATGGGAAAGTTTTATAACCTCTTTGTGCCCTCACCCCCATTCTTTTT
TTGAAATTTGTATAAATTTAGAGAGTACAAGGGTAGCTTTTATACCTGGATCTATTGCATAGTGGTGAAG
TCGGGCTTTTAGTGTAAGTATCCACTTTAATAGTGTACATTGTATCCATTAAGTAATTTCTCATCCCTCAC
CCACCTCCCACCCGTCGGAGCCTCCAATGTCTGTTATTCCATGCTCTATGTCCACGCCCAGGTTGTAGAC
ATTCTTTAGCTCCACTTATAAGTGAGAACATTGTGTCCCCTTATTCTCATCAGCAACATGGTACCCAGCG
CCCTTCTCCTGCTGGTGTAGTGTAAACTGAGTAAGCACTTTGCAGACTTGAAGAAGCCAGTGATTATTTA
CTATTTGCACTAGGCGAAATCCAGCCTTGGGTGTGCCCTCTGCAGTCCCTGCCGTGTCCGTGCATGTTGA
ATCAGAACAACTTCCTCAAGTGTATTAGAATTAGAATGTTAAGAAATCAAGAAAGCTCTCAAGGGGTGAT
GTGGCCCCCTTTTTAATTTTAATCACAGATTAAAATGCTATCGAGAAGAGGAATTTGCTCCAAGAGAAGA
GGGATTTCACAGTCCCTCGCCTTGCCCCAGTGCACTGCTTTAGTTGTTTGAAAAAGGCTGCCAGAAATTG
GGTAAGGATCACCAGGAAAAAAAAAAAAAAAAAACACAAAAATCTGAACATGCCAGCGCCCCCTGCCAC
CTGCTCCCATGAAAAGGCCAATTCAGTCGGCTGTAGTGGAAAACGTTCTCCCGGGTGTTCATTAGCTGGA
GGGAGGCTGAGGATGCAGTTTGGCCGTGGATTTCAATATTCCCTTGTAACGTTTTACAACCCAGACCCAG
CGACAATGGCGTCATTCATTGCACTCGCTCACGTGGAACAGAACATGAGAGAAGGGCAGAGCTGGGGAGA
AGCTGGTCTGTGGGCGCTGATACCCAAGGCCAGCTGAGGTACTCAGGACCCCCAGCTCGTGTTGGGGTCG
GGGGTCCCAGACTCTTGTCAGAGCTTGTCCATGGGATGCAGGTGTAGCTGCTTGATACAGCAGAGAGCAG
TGAGATTTGACTGTTGCAAACTAAAGTTTCTGCAAAGAGTAGGATAGATCAGTAGATCTTGATATTGCCC
GGGTGGAGCCAATATCCAATTCTCTCATTACCAGCATGCTTTATAAAGTGGGATTTGCCAAGTAGTTGGT
ATGGAGGTAACAATTGCTTATTATTAAGCATTAGTTAGGTGGCTGATATAATGGGCTTATGGGGACTTTT
ATCACTCATCCCCGTTCCACCATTCCCCTTGATATAGGGACTTGGAAGGAAGGGCGGAGGGGTATGAGG
GATAGAAGGCTATATATTGGGTACAGTGTACACTGCTCGGGTGATGGGTTCATGAAAATCTCAGAAGTCA
CCACTAAAGAACTAATCCACGTAACCAAACACTACCTATTCCCCAAAACAAAAAATTTTTAAAATGTC
ATGTGAAAAAAATAAACATGATAACTGATAGGAAAAAAAAGGTTAAATGAGGTCATAAGTGTGGGGCTT
TAATCTCACAGGATGGTGGCCATATAAAAAGAGGAAGATAGATAGAGAGAGAGAGAGAGAGAGAG
AGAGGGAGAGATCATCCCCCACTCTAACCCTCCCTGCCTGGCATGTGAGGACACTGAGGGAAGGCGGCCA
TCAGAAGCGAGGAAGACAGGCATCACCCGAAACTGACCATGCTAGCACCCACATCTCCAGAACTATGAGA
AAATACATTTCTGTGTGTGCTTTTTTAAAGTATTAGGTGGCGTGAGTTTTGGAATAGGATTGACCCT
```

| Sequences |
| --- |
| GGGTGAGACTCAGCTTTGCCTCTTAGCTGTGTGGTCTGGGACAAGTCACTTGACCTCTCTGTACCTGCCT |
| TTTCTTTTCTTTTCTTTTCTTTTTCTTTTCTCTTTTCTTTTCTTTTCTTTCTTTTCTTTTCTTTTCTTTT |
| CTTTCTTTTCTTTTCTTTTCTTTTCTTTTCTTTTCTTTTCTTTTCTGAGACAGAG |
| TTTCACTCTTGTCATCCAGGCTGGAGTGCAATGGTGCTATCTTGGCTCATTGCAACCTCCACCTCCCAGG |
| TTCAAGTGATTGTCCTACCTCAGCCTCCCAAGTACATGCCCAGCTAATTTTTGTATTTTTAGTAGAGACA |
| AGGTTTCGTCATGTTGACCAGACTGGTCTTGAACTCCTGATCTCAAGTGATCTGCCTGCCTCAGCCTCCC |
| AAAGTGCTGGAATTACAGGTGTGAGCCACCGTGCCTGGCCCATCTGCATTTTCTTATCTCTAATGTAAAT |
| GTAACTGTACCTGTGAAATGAGGTTCTTGCCAGGATCAAATCAGGATAAGCATATAAGTCAAGCAGTACG |
| GTGGCTGGAACATTAGGAGGCATTGAAGAACAATGTAGATGAGAATGATGATGATGATGATTAAAAAAAG |
| AGCAGGCTCCTTTTGCTGCCTGTATTTCTAGAGACAGAAGGGCTTTTCAACTTTCACTTTAATTCTCTTG |
| TGTCCTTGCTTCTTCATGGATGTTCTTAAGCTGTAGAAGAAAATAGTTTTATCTTCTCATCTGGAGGACT |
| TTAGAGATTTCTGTCATACTAACCACGTCTCTTTGGTTGACCGTTCCTTTGATCCATGGATGAGCTCTGT |
| GAAAATTGCCCCGCTGTTGTTTGATTCTAACATTTTCTTTCCTTTGCATGTGTAATTCTATAATGATTGA |
| GAAGTCACTTCCCCATTCCATGCCCATATTTTGACACTTGTCAGAGGGGTTTGGGGACATCGTATTTCAG |
| GCATTAACAGAGATGTTCACGATCGGTGTTGGGGATGATGTTTCAGGCTCTTTAGAGGGAAACAAGCTGT |
| GAGGGACAAGTGGTTATTGGGATGATATTGCTTTTCCCACTTCTGTGTTAGTAATCAAAAGCAGGACTTG |
| GCCTTTCCAGAGAGCAATTTTGCAATTTGGCTGTACTGGAACGGAGAATTCCACGGAGTCCATTGATACA |
| TTCTCTTGTAAACTCTCTCAGCCAACATTTTTTGGAGGTTATTTTCTTTAATTAAAAAGAAAAACTGTTC |
| CTATTAAAAATATAAAACCAAAAGAGATTTCCCCCTTCCTCTTGGAGCTCTGACAGCAAAATATTGGAAC |
| TAAATAGATCTAAATAGAATTGTCGGCAAGTTTTGACAACTTTTATAATGTTTTATTGTTATTATAATTT |
| TTCTTCTTTTTCTTTTTTTCTTTTTTTTTCCATTACGTAGCTTGAACCACAAAGCAAGAGCTGTAAAGC |
| TAATTCCATTCCCTTCAGCCTCCTGGCCCCAGGGGGAGATTCTGACTGGTGCGGCTGCTCGGATGGCTCC |
| AGCTTTGGTTCTGAGATGGCACAGGGAAGCTGGGCTAGGAGACCCCTGGGTGTCCTGAGGGTGTCTGTAG |
| ACTCATGGAAACTTGGCAGATGCTCTGTGTTCCTGCCTGGCCACTCTGGTGTGCTTTCACATGACAAACA |
| AAGGCAGGGACATAGGGTGGAGATGTTCACACACTTGAGGGGGTAGAAGTAGAAAGAGTCTTGTACCCCA |
| AAACCCTGCTCCCCTAAAAGCATATTGTGTTCTAAAAATTGAAAGACATCATTAGGATACAATGCAAAAG |
| TTATGAGGAAATGATTGGATTAGAATTCTAGTTGTGTCTCTTTCTAACTCTGTGATCTTGAACAAGTTGC |
| TTCATCTCCCTGGGCCTCAACTTCCTCATCTGTAAAATGGGATCAAAGATAATACCTATCACATAGAGTC |
| ATAGAAAGGATGAAATGGACGAATTCAAGATCCTTCAAAATGCGTTACGTGTAGCTCTTTGCGCATGATA |
| TTATTTCAGGTATACTCTTTAATTTTAATAGTTAAGCATTGATTGATTGATTGATTGATTGATTGATTGA |
| GACAGGGTTTCACTCTGTCACCCAGGCTGGAGTGCAATGGTGCAGTCATAGCTCACTGCAGCCTCAAACT |
| CCTGGGCTCAAGCAATCCTCTTGCCTCAGCCTCCTGAGTTGCTATGACCATAGGCACATAAACATTCGTC |
| TTAATTGCATTAAAATAACTATAATTAGCACCACAAGCCTGTAATTTCACAGATATGATCACTTATAGTG |
| AAGCTTAACTTATTTAGATAAATGATTAATTTTTAAAATGTCATAAGTTAAAGAATAGATGGCTGTATGT |
| CATGGTGAAAATTGTGTCTGACTGAAGTTTGGGATTTACTGACACATGCTCCTTCTAGGATAGGGGTTCT |
| TAAACTGTTTGATGCCATGGGCCTCTCTGGCAGTGTGTTGAAGCCTATGAATCATCTCTAAGAATAATAT |
| GATTAAATGCATGAAATAGAATACATAGGTTACAAGAGAAGCCAATTATATTTGAAATATAGTTAGCAAA |
| ATATGTTTTAAATGGCTGTTTAGCAATATATGCAGTTTGTAAATGCCATGCCCAAGATTCCCTATCCCCA |
| TCCTAAATGCTGGATATGGGATGTTAGGGGTCAAGCTCTTCTTCTCTCACATACTTGGATATTTCTCTCT |
| TTGTCCCTTCTATCTTGAAGCACCCCCACCCCCACCTTCTCTCTAACTCCTCTGCAACCTTCCACATCCCA |
| TCCATTCCCCACCTCTCTCATTTCCTTTGAGCCTCCTGCTGCTGCACAGCACGACTTTCCTTCTTCCCAG |
| GAGAGGTTTCTACTGAGTCCTTCTGAGGAAAAAAAATGGGAACACCTGGTATGAAATCTGAAGGTAAGGG |
| AATGTGGAGGACCAGTCCTAAGAGTGTGAGGGGCCAGATTTTGAGCACACTGAGGGATGCTATACCTATG |
| ATGTCATGGAATTTTTATTATGCTTACTTTGCCTGTGTGAGCCCTGAAGCTCAGGGGAGGGTTGTGTGTC |
| AGATGGACACACAGCCTGTAAGGGATAGGGATGGGGCCTGAATTGGGAGCTGCGTAATCTTAGATCCCAT |
| GCTGATTTTTCTTTTCTTTTCTTTCTTTCCTTTTTTGTTTCTTTTTTCTTTCTTTCTTTTTAAATCTTC |
| TATGTCCTTGTTCCTCCTTCTTTCTCATTTTCTTTCCCTCTCTTTTTTCCCTCCCTCTATTCTCTCTGCC |
| CAAAACAATAACAGTAATGACGATGGTTGCCATTTGTTGAGCATTTACTCTGTGCCATGTACCTTTCTGA |
| GTCTTTTCATGGTTAACTCATTAACCCGTTTCTTCTATCAACAGCCCTTTGAACTGGGGACATTCATTAT |
| CCCTACTTTACAGATGGGAAAACTAAGGTATGGAGAAGTTAAGTATATCAGTGGCCACAAGGACAGAAGC |
| TCAGGAGGAAATTCTGACACTAGCAGCAATCTATCCAGATGAGAGTAACTTAGGATTATACCTGACCTTC |
| CTAGGTTGTCAGCTACCAGTTTTTACTAACTTTGGGCAATGACCTGAGCCCCACCTTAAAGATGGACACC |
| CACAGGTTAAGTCTAAATAAATACTCAGATTAACTAGCTTTCAAATTAAGGAATTTAAAGACATACATAG |
| ACTAAATTGACATATTTCAAAATACCATGTGTGTTTATTGATTGTTAAAAGGGGTTCTTAACTGGGGGTG |
| TTTATTTACTTTTCTGCTGAGGTATAGAACTGTTGGTAAATCTACTTGCCTAATGTATAAGGCATCAAAA |
| ATTAGTACCCAAATATACATTTGTGAAATATGATGGACATGAATATAACTGGATCATTTTATTCATCAAA |
| GACCTCTTTTTTTTCCTTATTCTGTGACTTTTCTGGTGGATTCTCTCACACCTGGTTCAGCCACTCAGGA |
| AATCTGTATCAGGGCACTGATAGGCGTTATCTCCCATCTTTTCTCTTTCAGTAAAGAATATCCCGTGGTC |
| CCCAGGAGCACCGTGAGGCAAAAGTGGCCTCCAACCACAGTCCTTTCAGCAGCGAGTCTCGAGCTCTCT |
| CCACCTCATCCAATTTGGGGTCCCAATACCAGTGTGAGAATGGTGTTTCCGGCCCCTCCCAGGACCTCCT |
| GCCTCCACCCAACCCATACCCACTGCCCCAGGAGCATAGCCAAATTTACCATTGTACCAAGAGGAAAGGT |
| GAGTGTGATCACCCCTGGTCAATTTGGTTTCTTTCTTACCTTTTCCTTTCCTTGGGTTGGGGGTGAGGGG |
| GTGAGGAGTATTCATTTATTTACTTTATTTATTTAAAAATGTAAACAACACAAAAATATGGAGATAAG |
| AAATTTAAACCAAACAGCTAAAACAAAAAGTTCCCTTGACATGTTCCTACCCCCAGTTCCAGCCCCTCCT |
| TTGGAGAAAGCTTATTTGAAATGTTCAGACCTATTGTATTCATTTATGCACACATACACGTGGCGAGTGC |
| AGAGAAAGAACTAGATTTATTTTTACTTTTTTTTTTCTTTTTTTTTTTTTGAGACAGGATCTTGCTC |
| TATCACCCAGGCTGGAGTGCAGTGGTGTAGTCATGGCTCACTGCAGCCTCAACCACCTGGGCTTAAGTGA |
| TCCTTTCACATCAGCCTCCCTAGTAGCTGGGACTATAGGCATGCGTTCACACACTGTACTAAATTTTTGT |
| TGTTGTTGTAGAGACAGGGTCTCACTGTGTTGCCCAGGCTTGTCTAAACCTCCTGGGCTCAAGTGACCCA |
| CCTGCCTTGGCTTCCCAAAGTGCTGGGATTACATGCCTGAGCCACCACACCCAAAATTTTTTTAAAAAC |
| TTTTAATATAGATGAAATCACACTGTATGTATTTTGCAACTTGCTGTTTTTTTCTTTTAAACTTTAGAA |
| TGTGTTTTGGGTATCTTTTTATGAACCTAGACTGCCTTATTTTATTTTTAACTGCTAAGGAGGAAGAATT |
| GACTGGAAAGGATAAAATGGAGTTTATTTTGTCACTCCCTCTGGTAGGCAGGGAGGTTGCTTGAGTGGTC |
| CCTGATGGTATTACAAGCCGTGATGCAGGAAAACCCCTTGTGACTATCAATGCTTCTCTGGCATATGTGT |
| CAGTGTTTCTCCCAGGTGGATTTTGAACTCTTTTTTTTTTTTCCTGATCAAAACCAACACACACACACA |
| CACACACACACACATCACAAATGATTTTCCCCGTCTCATCCCCCATTTAAATCTACTAAGCTGAGGCATT |
| CCGCAGTTTTCTTTGCCACATGAGAAATAAATGGCTTTTTTTTTTTCTAAGTCATCCAAGTCCAAAGGG |

-continued

Sequences

```
GCTAAGCTAAAGAAAGAATTTTCTGGTGGCCCTTCTTGTGAGCCAGAATAGAAGTGTTTGGCACAGGTGG
TGTGGTGGAGTTCAGCTCGATAGAACCATTGCTTGGTGTGAGCTGTAGATGGTATGGTGGGGAGACTGCA
GCCTTTGGGGACAGAGAGATGCGGGTTTGAATCTGATCTCTGCTCCCTGCTTCTTGTGTGACCTCACTCA
GGTGTTCTAGCCTCTCCTAGCCTCAGTTTCTCACTTTGTAAATGATATGTTTCCTAAAGCATCTGATAGT
TAGCAAGTACGCAGTAGGTGGCAGCCATGATTGGGTATGTGGCAGATATCGCTCCAGAAGGTGATTCCCA
GGAGGAATCTGCCTCTTGTCTTTGGACTGGCATTAATTTAATCAGTCTTCCCAGAGAAGACTGCCTCTCT
AGGTGAGAGCTTGAGAAGACAGATACAGAAGGGATGGGGTAGGCTAAAGTTTACATCTGTGGTCTGTAGA
ATCAATCAGGATGAAGTTCACCTTTGCAATTTAAAAATTTTCATAAGTAGTGACAAGTTGCTTAACCTTT
CCAAGCCTCATTTTTAAAAATCTGTAAATATGGGCTCAGGGTACGACTTGTCTCATAGGCTTGGTGCAGA
GATGTCAAAAAATCATACACATCATATGTTATCTCAGGGTTGACTCAGAAAGTAGTAGCTGTTTTGCTCT
AAAAGACACTAATTTTAATCTACAAAGTGGCCTGTTGAACCTCACAGCCTCAGTGGTCAACACAAGCCTT
TGTGAATCCAGTGCCCAGTGCCTAGCCCTTTAGGAAAAAATAACTCGCTAACAACCAATGGGAATGGATG
CTTTGGTAGCTTTTTCTGGAGCTGGGGTTACATGAGGAAAGTAACATAGTTTGACTATTTGACATTTACC
AATCTTGCGTTTTAAAGGAGGGAAGAGCTGTCATTGGTATTTACATGGGGCTAGGAGCTGACCTGGATGA
GGCCTGACTTCCAGACTTACCTGAAGCCAATCCAAACTCCTTGAATCTCAAAGGCCTGAACAATATCACT
CCAACAGGCCCCCTGGCGTGACTCCCGGCACGTCTGCTGCCGGATGGACTGGAGACCAGATGCCTGCAAA
TATGTCTGCCTCTTTAGGCATGAGCAGGAGGTTAAGAATGTCCTATGGGACACAGGTCCCTGAATAGAGA
TTCTGTTTTATATTATATTTAAGGGTGCCCTTCCTAAGTCCCAGATCAAGCTTTTTCGACAACACTATGG
AGTAGATGCTATTATTAACCCACTTTATCAATGGGGAAACTGAGGCTCAGAAAGGTTCCAAACAAAAACT
GCCAGTGGTTCTTGAACCCCAGCCTGGTCTGCAGATTCTATACGTGTGCATTTCACCACTACTCTATACC
GTCTTGGTTACCTTTGCTCATCTGCTACAATCTCAAAATTTCATTTTCCACTGAAGATCTGTCTTTGAGA
CTGGGTCAAACATGCTGATTAAGAGCTCACCAGGTTTGAATTCGGGAGCTCTAATCGATTAAATTAATGC
CAGACCAAAAGACAGGCAGGAAGAAGTTAAAAAGGATCATGGTGCTTTTTAGGTTCAATATTTACAGCAG
CATCCTTATAAATGCATCCCTGAAGGATGCGGCAGGGAGGCTTTGAATTGCACGGTTCACAAACCTCTTAG
GTTATGACTTGACTTTCATGGACTGTTTGTTGGATCCTTGGATGAGCTTAAAATCAACTTGGAGTGGCCA
CTGGGGAAGCTGGAGTTGGGGCTGATCCACTGTAGTAATACTCACAGTTGACGACACTTGGCAGCTGTG
TGCCCAGGGGCAAGTTGTTTTACCTTTCTGGGCCTCAACTATCTTTTGTGCAAAATGAGGATAACAATAG
CACCTGCTTGATACGGTTGTGATGAGGGGAAATGAGATCATCCACAGAAAGCACCTAGAACAGTGTCTGG
CACCTACAAGTGCTCAATGAACATGTGCTTGCCACAGGCCTGCCCTTGTGAAGCTCATACGGTTGCAAGC
AGGTTGGACATTATACAAGTAATTATAAATTGCTTAATTGAAATTGTGAAGCCTGGCACTGTGGCTCACA
CCTGTAATCTCAGCATTTTGGGAGGCTGAGGCTGGAGGATTGCTTGAGTCCAAGAGTTGGGACTAGCCTG
GGCAACATAGTAAGACTCCATCTCTACAAAAAATAAAAAATTAGTCTGGCATGTTGGCACATGCCAGTGG
TCCTAGCCAACCCAGGAGGCTGAGATGGGAGGATTGCTTGAGCCCAGGAGTTCGAGGCTGCAGTGAGCTG
TGATTGCACCACTGCACTCCAGCCTGTGTGACAGAGAGAGACCCTGTCTCAAAAAATAAATAAATAAAAT
AAAATAAATGATTGAATGCTATAAAGGAGATATGCAAAGTGTTAAGGAATATCAAACTGGAGTGTCAGTC
TAGGGTAGGCAATCAGGGAAGCATTGAGGCTGAGATCAGAGGAGACTGAGTGCTGGATAGGAGAAGGGGG
AGGTGTGAGGGTATCCACACATAGAGGGAAAGCATGCATGAAGCCCCTTGGCTGAGGGAGAGCCTGCCCC
TGGGGAGTGAACAGAAGGCTGAGATGTTGGCACTCAAGGCAAGGCAAAGTGGTGGGGGATGAGGGCTAG
AGGGGAAGGCAGGGACCAGTGAGATGCCAGCCTGTATAAGCCATTTTAATGAAAGATGTCAGATTTTATC
CTACCACCAGTGCACGTCCATTGGAGGGATTTAAATTTGTGAGTAACATGCCTAAGTTCTTTATTTGGAA
GCAGTCACTGCTGCTATGATAGCACAGGACTATTTAGTTGGCACCAGAGACCCATTGAAAGGCTGTCATGG
GGTCTGAAACAGGAGATGGTGGCTCCGACCAGGGTGTGGGGAGAAGCTGGAGATGTGGGTGGAATCAGGC
CTTAGTGGCTGGTTGGCGATAACAAGGTGAAGAATTACCCCACTTCTTTGTGGATTTGGAAACCAACACT
GAGGAACTTACCCAAAGTCACTCAGCTCGTGAGTGGCCCAGCTTGAGATGTATACTGAGGCCTGTGGGCT
CAGGGTGAATGGGGTATGCACCCTGGAGAAATCCTTTCACCTTTCCAGAAACTCTGCCCTTCTCACCTCC
CTCCACCCCCAAAAGGGAGCTCCCAGTGACAGGGAACATTCCAACCGAGGGCTCTCTGTCCTGCCTAGGA
GACAACAAATAGCAATTCATCATCAGCCTCCACACTGTAAAGTGATAAGGAATCAGCCGAGGTTTCCTTC
CAGTTGGGATTCTCATTAAGTGATAACTCCATGGGTGGTTTTCCCCTGGCCCCTGCCTGCCCCACTATC
TGACTTCCCCTCATTGTCTGTCTCCTTTCCAATGAGCCCAGGAGGTCAGGCCCAATGAAATGTCACAGGGC
CAGGCAGGCCGGAGGGCTCCTTGTGTTTGGAACCGGCTGTCTCCAAACTATCTCTCCCGATGGACTGAGC
CAAAAAAGCTGGGAAGGTCTTTTATCAATGCCACTCAATCAAATCCAGGACCCCAGGGCTGGGAGAGCA
CTTGTCTGTCTTTCTCCCTCTCACCCCTGACTCTCACCCCCACTCGCATTAGAAACTAAAAGCAACCCAA
ATAAAGATTCTAGCAAAGCCATGAGCTGAATCAGATATTCAAAGGAAAGTTAGAGATTGAGAGGGGAAGG
GGAATTCGATATGGAAAAGGGCTTTGCAGGGTGCATTTTCTGAGTGCTATGTTTTAAAATGCGATTTCAC
ATCCATTCCTTTGCTGATTCTCCAGTTCCCTGCAGCAGTCTTTGGACTAGGGGAGATGCCACCCATCTCT
ATTTTGCAGGGATCTAATGGAGGACCAAGAGACAGGGTTAGATTTTAAGCTTATGTGGCTGATGATTGGC
AGATCTGGGATGGATGCATCAGATTAATCTTTATTTATTGAGCACTTAATGTATAATGGACACTGTGCTA
GGTGCTTGGGATAAGTGGAGGACATGGTGGAAAAGGCTCCCGCTCTCAAGAAACTTGAATTCTTACTGGA
TGAGACATATAATAAGCCAGTAAGTAAATTTATTGGTTTCAGGTAGTGACTAGGTGATGTTTCAAACTGA
GTCTTTTGATTTCTCGTTGAGAATCTTCGCACAATACCATTCCAACCCTTCCTACTTTATGCTAAGAGCA
TGGGGACACCAAAAACAAATAACAACAACAAAAACAACAACAAAAAGTCATCCACCCACTCATC
CACCCACCCACGAATCCATCCACCCACCATTCACCCATCCACCCACCCATCCACCCACTCACTCATTCAT
CCATCCACCCATCCATCACTCATCTATCCACTCACTCATCCATCCACCCACTCATCCATCTACCCA
CTCATCCATCCAGCCATCACCCCACCTATCCACTTATCCATCCACCCACTTATCCATCCCCCACCCATC
TATCAACCCATCCATCCACCTACCCAACCACTCACTCATCCATCAACCCACCCATCCATTCACCCATCTA
CCCACCCACCCATCCATGCATCCATCCACCCATCCAACCACCCATCCATCACCCCATC
CTCCCACTCATTCATTCATCCATCCATCCACCCACCCACCCACCCATACATCTATCCTCCCATCCATCA
TCTACTCATCCACCCACTCATCCATAAGAGTCAAGGTTTGCTACCTTTTCATGTTGGCTGAGCATGTAGG
GTTGCGTGAAATGGAAAGCCTGGGGCATCTGTCAGAATGAGCACTGCTTTGTGAGTCAGAAGACCTGAA
TTATAGCCACCTTCCCAACTTGCTGAAGGTCACTCAGCTAGAAAGATTACTACTCTGAGTTTCAGGGTCT
CTGTCTGGGAAGACTCGCCAATGGTTCTTCATCTGAATGAACTGAAATGAAGAGAAATGACCCATTTG
GGAATAGTGAAAATATTTGCTCAATAGGATTAGTATTTAAAAGCACTCTGTGAGCTTTCCAGCTCTGTAA
TCTACCCAAATACTATTAAGTATGGGACAACTTTCAGAAAGCTATCTATCCAGTCTTCCAAAAGAGAAAG
AGGGAAAAGAGAATGGACCCAGGTCATTTGGACAGACAAGATTTGAATGCTTTATGTGCAAGGAAGATAA
AAACTCAACTGCCCTCATTATTACCTCAATTAAATCTCATAAAAAGTTCAGGTATTATCTCCATTTACAA
TCAAGAACTGAGATTGGAATGACCTGGTGATTCATCCAGTCACATGGCGAGCGAGCATTGGAGCTGTAAC
TCTGTGCCTTAATATCTGTGCCTTGGATGCATTACTAAATTCACTTTATCCGGAATCAAAAATATCTAGA
```

-continued

| Sequences |
|---|
| AAAATCCAAAGTACTAGGGTTTTCTACAGTGCCATGCCATAATGAGTGGTCAGAATCAGGAAGAATTTAC |
| TGTTACCTAAGAGACTCATTTCGGTTTAGGATAGTTGCAATATAACTGACCACTCTTAATATGCAACTTT |
| CTGAAGCCGAGTTGTGGACTCATCTCATCAGAAGACTTGATACTTAAGTATAGCCCATTTACCAACCCTG |
| AAAGTTAATCATGACTTGGCTGGAGATAGGTCTTTGCTGTTGAACAGTTATTGGGCTCTCAAAGAAGAGA |
| AAAAAGAAAGAAACTGAGCCATAACCAAAATAAACACAGAGATTACATCCAGAGCATTTATCATGACTGA |
| CCTGAAATTTGGATCCTTGAGTTGGAATTTCTTTACAATGTGATGAGGCCTGAGAGGAATTTGAGAATGT |
| TCAGGACCTGCTTTCATCAATAAGCCAAGATTGAGTTTTTCTTAGTGCTCTGCATTAGATCTTTGGGGTA |
| TTAAAGACTGGAATGTATAATTTTACGATTTTCCAAAATGTGTTCCGGCCGTTTTCTTATTATTCTTCCT |
| TTTTTACTTGTAACAAATCTGGAAGGGGATCAGAAACTTGAAAATAGTTAGTTTGCCTTGTTTTTTTTTC |
| CTCTTGCTAAGGGTGCCCTGCAGCTGTACTTTCTATTATTGAAAAGGGTAACACCCTGGTTAATTGGAAA |
| ACCCAAAGGTTATGATTCCAGCAACAATGGAAACACTCAGGTTTATGAATCTGGGGGAAGGAAGGAAGAA |
| TTGAAGGAAAGGAATCAAGGGAGGAGGTGGTGAGGACAAAAAGAAGCTGAGTATAGCAATGTCTTCAAGC |
| CTCCAAACAAACAAACAAACAAACAAAAAAAACCCCGCACAGTTAAAAGGTGAAAATGTGG |
| CCGTTCATTCATCTGGATGTTTTCAAACATCTGCATGGTTGGCATGATGTAGATAGAACACCTGGAAGAG |
| TGTGTTTTTCTTTTTTTTTATTTTTGGTACAAATTTTTTTGGTATCCTATAAGTCCCATATGTGGCCCA |
| GAAAGAGTCTAGTGGAAATAAGTTTACTTGCTGTTAAGTGGGCACAACCCTAAGAGATATGTTTTGTTTG |
| TGGATACTTTTGGCTTATCTGTGGGTGTCACTTGGACATTGATACAAATGGAGCTGATTGGTGGAATCCA |
| AACCCAAGCTACTCTACCTGGGTTTGGGAGCTATTTTACAAACCAGTCCAAAGCCAAAGGATTTAGTCTT |
| GAGTCAATGGCTTACTTGTGTCTTTATATCTGAGGACCACCTCTCAGTCACAGAGTGTCAGCCTCCCTCA |
| CTTACTGCTCATGGTAGGATAGACTGGGATTGAGGACATGCACCAAAAACGGGATCATGTTCACCACTCT |
| ATCTCCAGCACCTGGCACAATACCTAGCACTTTGGAGCAGCTCAGTAATTATCTGCTGTATGATTGCATG |
| AGTGGCACTGGGTATTAGAAATCTAGAGAGTTGGAAGCAAGGTGTGTAGGCAAAGTCAATCAATCTGGC |
| TTAGATTCCAGCCTCTGTTCCTTCTCAGCCATGTGACCTTGGGCAAGTCACTTCTCTGAGCTTTAGTTTC |
| TGCCTTTATGAGACAGGCATTACAGCAGACACCTTGAGGAATTACTGTGAGATGAAGAGTAAGGTCATGT |
| AGTAGGTACTCAATAAATAATAGCTCTGATCATTTCCTCTCGTTATTTAGTTCAGCATTCTGTTTTCATG |
| GCCATGAGCCATCACAGTGAGTTGCATGGATGCCCCAGTGTTTCATTTTTCTTCACTTCTCCAAAGACAG |
| ACATAATTTCTTAACATTTATTGACTAGAAAGAGACAGAAAGATGAGGAAAGAGAATTTTCAGTTTGGAA |
| GGTAAAATTTCAGATAAGTAATGAGTCTGTGTTGAGGTTTATACTTTGGTAGATATCCCCAAGTATTGCT |
| TCCCCTGAAGGGAATACTTTGAGGGTATTATTGTGAATTATGTCTGCCATGAGCCTGACTGGTGGTGTTA |
| GCCCTGCAACAAGAGCTGTTCATGTTGACGGAAATCAGGAGACTTTACATGCTCAATCTTAGTTCTTAGC |
| TACCCAGTAAGGTAAGTATTACTCACTTTGATTCAGAGATGATGATGAGTCTCTGAGCGTAGATGCCCTG |
| CTGGTATCACGCAGATATTAAGTAAAGGAGCCTGATTCAAATCCAGACATGTCTAGGCTTCTTAACCTGG |
| GGTCTGGGTTTAGGGAGTCTTTGAACCCCCTGAAATTGTATGCAAAGCCTTGTATGCACATGCAGTTTT |
| CAAAACATTGTGTTTCAATGCAGTTTTCTAGGAAAGAGCCCAGCACTTTTTCTTGTTTTCAAAGGGGCCA |
| GTGGCCCCGAAGTGGTGAAAGGAGACCCCCTTTCAGAGACAAAACTATCTCCACTTCCCTACACTAGGAA |
| ATGACTAGTACACAGGGAAGGGAAGGGACTTGCTCAGCAGGAACAGCAACACATTAACTTGTACCAACT |
| TAACAAATACTAACTAGGCACATGCTTACATAAGGAATCAGGAAAGAATTTGAACATTCATTCAAGCTCC |
| CTCCCACTCATCCATGCATCCATGCATCCATGCATCCATCCATCCATCCATCCATCCATCCATCCATCCA |
| TCGTACAAATATTTATTGCATGCTTTCTCTATGTATCAAGACAGTGAAAAACAAGGGCTTTGTGGTCAGA |
| CTACTTGGATTCTAATCCTGGCTCTACTGTTTATCAGCCATGTGAAACCTTGGGCAAGTTTCTTAACCTC |
| CGTGAGTCCTTTTTCTCTCATCTGTAAGATGAGGATAATAGTAAAACCCACCTGGTAGGGTTGTTGTGAT |
| TAAATGTGTTACTTCCTGGAGAGTGCTTAGAATCGTGCTACGCAGAGTACACACTGTATATGTTTGTTTT |
| GACTTATTGTTGATGCTGTTGTTAATAGTAGGTGTTTACTAGGTTCTGGGAATATAGTCATGGATAAGGC |
| AGAAAATGTCCTGCTTTTATGAAATTTACATGCTGGAGAAGAGGAAAGATAATAATAATTGCTATTTATT |
| TATTTTTGAGATGGGGGGTCTCACTATGTTGCCCAGGCTGGTCTCAAACTCCTGGGCTCAAGTGATCCTT |
| TTTCCTTGGCCTCCCGAGCAGCTGGAACTATAGGCGTGCACAACTGCACCTGGTTAGTTGCTATTTATTG |
| AGTGTTTCTGGGCTCTGGACTAAGTGCTTCATGTATTTTCCCATTTAATTCTCAACACTGCCCTTTGTAG |
| GAAGTGCTATTTCCTACCCTTTCCATCTTACAGATGAAGAAGCTGAACCCAGAAAGGTCAAACTGTTTGC |
| ATAGAACTCCATAGCCCAAGGTCTTAACCATTACAATCCAACCCCCTTTTTTTGTATTCAGAATGGCGGT |
| TAGGGCTAACAGTCTCTCAGGACTTATTCTTCAGTACTTTGGCCAAATAACTGTCTCCACTTTTAGCTGC |
| CTGGTGCCTGCTCCTGGCCTCACTGCTGTCTCTCCTGTCTTCACAGAGGAAGAATGTTCCACCACAGACC |
| ATCCCTATAAGAAGCCCTACATGGAGACATCACCCAGTGAAGAAGATTCCTTCTACCGCTCTAGCTATCC |
| ACAGCAGCAGGGCCTGGGTGCCTCCTACAGGACAGAGTCGGCAGCAGCGGCCAAGCTTGCATGTATGCCAGC |
| TCTGCGCCCCCCAGCGAGCCTGTGCCCAGCCTAGAGGACATCAGCTGCAACACGTGGCCAAGCATGCCTT |
| CCTACAGCAGCTGCACCGTCACCACCGTGCAGCCCATGGACAGGCTACCCTACCAGCACTTCTCCGCTCA |
| CTTCACCTCGGGGCCCCTGGTCCCTCGGCTGGCTGGCATGGCCAACCATGGCTCCCCACAGCTGGGAGAG |
| GGAATGTTCCAGCACCAGACCTCCGTGGCCCACCAGCCTGTGGTCAGCAGTGGGCCTCAGACTGGCC |
| TGCAGTCCCTGGCACCCTTCAGCCCCCTGAGTTCCTCTACTCTCATGGCGTGCCAAGGACTCTATCCCC |
| TCATCAGTACCACTCTGTGCACGGAGTTGGCATGGTGCCAGAGTGGAGCGACAATAGCTAAAGTGAGGCC |
| TGCTTCACAACAGACATTTCCTAGAGAAAGAGAGAGAGAGGAGAAAGAGAGAAGGAGAGAGACAGT |
| AGCCAAGAGAACCCCACGGACAAGATTTTTCATTTCACCCAATGTTCACATCTGCACTCAAGGTCGCTGG |
| ATGCTGATCTAATCAGTAGCTTGAAACCACAATTTTAAAAATGTGACTTTCTTGTTTTGTCTCAAAACTT |
| AAAAAAACAAACACAAAAAGATGAGTCCCACCCCCACTAGCACCACACCCATCAACCAGCCACATTCAC |
| GCTACTCCCCAGATCTCTTCCCCCATTCCTTCTTTTGGGCTCTAGAAAGTCTTGCCTCATTGAGTGTTTT |
| TCCCTAGTGCGTAGTTGGAGTCTGTCCCTGTCTTGGTGTTAATGTTGACATTGTTATATAATAAATGATA |
| ATATATTTTTTCTTTCAATTTTCTTAATGGGACCCAGTCCCTTATTTGGGGGGAGGTCTGAGGCAAGTA |
| TATTTCAAAATATGTACTTGCGGGATTCCCTTCAAGTAAAACCATCCCTGAAACCTAAATTCACGTTTCCC |
| CTTGACTAAGAAAAGCACCTACCTCTGCCATGTGATGTTTCTGAAAAGCCTCTGTATGTCCCCATTTGCT |
| TTGGTTTTGTCCTGCCTTCTCCAATATCACGTGCTCAGTTTTGCCTCTACTTACCCATGGAGTCAGGATA |
| ACACTGACGCTCCCTGGCATCCTATCTTATTCAGCCCTACCATCTTGCCAGCTCTGTCTTTCCAGCTGTC |
| TGTCGCTAAAACGTGGCCTATAGCTTCCCTTCCGGAAAGCTTGCTTTGAAAAACTTAAAAAGCCCCCGTT |
| TAGATGTAGGCAGGACTGTGATAACAGTGCAAGCTCTGTGTTGACAAGAGTTGTGGACAAAAAGCCAAAA |
| TAAATATTCTTCCTGATTAAAAAAATTTTTTTGAAAAAAACAAGGCCAGCCCCAACCTTCCAAACCTCC |
| ATCACCAACAACCCAAACTGGATGTCAAGCAAAATGCACAATTCCTACAGAAGAGGCAAGACACAGTCAC |
| CAATGATATCTCGCCAAAGAAACCACGCCCACACCAATGCCAACACAAAACTGTGTTTACTGAAAGCCGA |
| AAACAGTATTAAAAAAAGTGTGTAAGTAAAGTGTTATGGTAGGGTTCTTCAGATGTAATATTTTACTGGT |
| ACTATTTATTTATAAATAGGAATTCTAATTAAGTAATAACATGAAATGAAACCCAGCATAGGAGCTGGCC |

| Sequences |
|---|
| AAGAGCTTTTAATTTTATTGATACTCAAAACCAAGTTTGTGTTTTTTGTTTTTTTTGTTTTTTCCTC<br>TTTCGAATGTGCTTTGCTTTTTTTGATTAAAAAGAATTTTTTTTTCCTTTTTTATAAACAGACCCTAAT<br>AAAGAGAACAGGGTAAGATGTGAGGCTGAGTGTGTTTAAGTACGTGAGAGAGGTGTGATGTGTTTGTAAG<br>TGAGTGTCCCTATGCGATTATGTCTCTTTACGTTGCTAAGGGGGAGGGTGAGGATTAAGTACTCGTGCC<br>TTATATTTGTGTGCCAATTAATGCCTAATAAATACCATGTGCTTAAACAAGTA (SEQ ID NO: 46)<br><br>Pig TBX5 (Gene ID: 100522280)<br>Location: chromosome 14 Exon count: 12<br>Range: 37772205..37826015 (53811 bp)<br>>NC_010456.5:37772205-37326015 *Sus scrofa* isolate TJ Tabasco breed Duroc<br>chromosome 14, Sscrofa11.1, whole genome shotgun sequence<br>TTTCTAAACTCTTCACCTGAACAACCCCTTACTAGCCAGGCGTCACTCACCGGCTTCCACGCTGGAAAGA<br>AGAGGTGGGATTTTGGAGGTGAGTGTCGCCCTGGAGAATTCTGGGGATGAGGGGTAAAGGATTCTCTTA<br>GGACTTGCCTGCCCACTGCCTCCTCGCTTTCCGTCTCAACTCAGCCCTGCTGGATCCCCCCCTCCCCCGC<br>CCCTTGCTACTTTTCTCTGTGAAATAATGCACTCTCTTGCTTGCATTTTGCCTTCCAGTGTCACCTGGCA<br>AGAGGAGATTCCCCCTTGAGGTTTCAAAATCCCTGGTTCGCTTGGTGGCCCGCAGTATCTGCACTTCACG<br>AGCTAAGCGAATCTGGCCAGGCAGTTACTTGGGGGAGTAGAGATTCTTCCCTCTCCAGAGGGGCCTGCAGA<br>TTATTTATGGGAATTTATTTTATCCGCAAATCTCTGAGAATTTAAAGGGATTGGAGAGCGCTTTCTGGAT<br>TTCCCCTTCCTTTTGCCCGAGATGCAGCCTCATCCTGAAGCCATGTTTGTTTTCTGTCTTTGGCCGGGGG<br>TCGCCCCTTGAGCGAGCCCAAAGTCCTCGGAGCTGACATTTTGGAAGGGTGAGGGTGTTTTCACAAATAA<br>ATAAACTGTCTTGGCAAAAGGCTGTTTGAAAGCAAACCTGGAAGGTGGAGTGAGAACTGCAGCAAATGCT<br>CCAGCTGGTTTTCTCCCTGGTTGTCCCACTTTTAGGGTTGGACGATCCACTCTAGAATTTTGCAGCGATG<br>TGTCAGGCCTGCCTTGGGATTTTAGTTCCAAGGGCCTGAGAGGATTACACCGAGGCGGCCTCAGATCTCC<br>AGGGCAGTTCTCTTCCTTCTGTTCCTCTCCCCAGACCTTGGCTTGCAGGCCTGAATCTCTAGGCAGAGCC<br>CCAGAAAAGAACCGGGTGAAGGAGACGTGGGTGAGAAACAGAACAGGAACCCTGACATTTGTTCCAAGCA<br>CTAATTCTTGGTTTTCCAAACTGGGTCTGCTCAGGCTAAGACCTACTGACTGTGTTTACGCTTCTATTGA<br>CCTCTTCAACTCGACCCTCAAAATAATACATTTCAGAGAGGAGGAGGGAGGGAGTGGAGATGAAAACCTG<br>AGCCAGCCCCATTGACTGTTTGATTATTTTAATAATACTGGGCACTGCCTTGTGTACACCTCCAGCCAG<br>GGAGGTCTGGTGGCCCTGGGAGGGTGGGGGTGGGAGCGCAGGGCGATTTCTTGGCATCTTTGATCTCGGC<br>TCCCATCCCAAGGCACCTTCACCCTGCCTTCACCCTGGAGTCACCGAGAGTCAGGGTGATGAGTGGGGAG<br>GGGGGGTGATGTCAGGGCAGCTAGCAGCAGCAGGCTGGGCCAGGCGGGGTCAGGCAGCTCTCCGTCTTGA<br>GGTCAGCGGTGGAGGGAGAACGCTGGCAAGGCTGCAGAGGAGGCTGCTGGTGGCGTGTGCGTGCACTC<br>CTAGTGCGTTCAGGCTCCGTTCTCTGCACGGCCCGTGTCACCGTGATTACTTCCCGGGCAGAAGCCGACC<br>GGGGTTTGCTATGATTTGTGCGGGATTTTTTGCAGCCACCGAGCCTCGCTCCGAGAAGCAGAGATGGATG<br>GAGGTTGGGAAGGGGTGGAGAGGAGGGGGTGATCTCGAGGTCTGGGTTTGAGAGTCCTGTGGTGATTTG<br>AGTGTTCGGGAAATCTAATGGAAAAGGTGGTTGGGGGGAGGAGGTGGGAAGGGACTGGGAGGAGGGAGGGA<br>GAGAGAGAGGGGGAGAGAGAGAGGGAGGGAGAGGGAGAGGGAGGCAGGGAATGTGCAGTGGGAGCTAGCT<br>GGATAGGCATTTTCAGTACTTTGTAAGCATCAAGGCAGCCCAGCGTCACTGACCTCAGCTGAGTTGGCTT<br>GTATTTCTGAGAGAGAGAGAGAGAGAGAGAGAGAGAGACCGACTTACCTCGGATTCCGGAACTCTA<br>ACCCCGAAAGCTGCGCTCAGAAAGGACTTCCACCATTCTCAGGGCTCTCTTCTCTCCCTCCCTGGGGT<br>GCAAGGGAGAAGCTGGGCACTGAGATCATACTGCTGGGGGTGCTCACAGAGGCTGCTGTTTTGCGTTTTT<br>CGGAGCCCTTCTGGCGCCTGACAACTTGAAGTCTAGAGAGAGAGCGGGCGCAAAGCGGAGGAGGTGTGTG<br>GCGGCTGTGGGTAGTCGCTACCAAGGCTCCCCCGGTGGGTGCTCCTTTGTAGGCAGCGCTAGCCGCCGGT<br>CTGGGGAAGCAGCCCCCCGAGTAAACCCCGGAGCCACCATGCCCGCGCCCCCGCCTCGCCGCCGGCTTC<br>CCTGCTAGGAGCAAGAAGGCGTGCGGTGAATGCACCAGCTTCGCCGCCGAGGAGGTAACTGTTCCGTAG<br>ATGGCCCGGAGAGGCTCGGGAGGGAGCCGGCTGGCCGAGTCGCCCGGGGAGGCGCGAAGGCTGCACTCC<br>AGCCTTGTCCGGGATTCTCCAAGGCTCGACTCGCGGAGATTTTGCGCGGCCCGGGGCTGCCCGGCGCGGG<br>GAGCCGAGGAGGCGGCCCGCGCCCGCGGGAGCCGGCGCGAGGTTTGCAGGACGCGCGGCCTGGTTCTGT<br>CAAACCGCATCTCGTTCGGCTCCCTCCAGCCCCGAGCTCTCGGAGGCTCGGGGTGGGATTGTCCCC<br>TCGGCCGGCGGTGAATGGGAGCGCACGTGGGGGACGCCAGCCCCGCTTTCTTTTGTTGTGAGCAGGCTTC<br>GGGGCTCCTGTTGCCGCCTCCCCCGAACCCCAAGGGCGTGGTGAAGGAGGCCTCGGACCCCATTTCTGGG<br>TCTTCAGCCGCTGCAGACCAGGGTGGGAACCAGCCTTTTGGTGTAGCAGCTGCTAAGATGCTGGGGGGGG<br>GGTGGTGGCATTTCTTGTGCCTCCTTCCCAGTCTTTCCAGGGTTTGGAGAGAGGAAATCCTTACTTGTGAA<br>CGTAGAGGAGATCAGAGCAGAAGGCAAGCTCCTCCGGGGTTGAAGCGTGCTGCAACTGTTATTTCCAGTG<br>TTCCAACCTCACATGTCCATAAACCCGGGCCATTGCACGCGTTGTGTTGGACCCCCGTGGACTTCAGTGG<br>CCGGTTCCACACCAGAAGCCCAGGATTTACCTGGGAATCACTCTGTGGCCACTAACCTAGAGTTTGGGCC<br>TGTAGTTCCACCGAGCCAGGCCTGGCTGAAGCTCGCAGAATCTCCCCTTGGTGAGGCCGCTCAACAAAAC<br>CCCCCTCTGTAGCTAGAGAGCAGAGAAAAAAGGAGAATGCACCCCAGGCCAGAGGCTGAATGCTGGCCTC<br>AGGCACCCAGCACCTCGCCTCCCTCCCAGCTGCTGCTCGGCTTGCTTTCTTGTCCCTTTCTGTTTGGCTA<br>CTTTTTATTTCTCAAGTTGCTTATGGTGTGTGCGATGGGGGGAGAGGACTCTTAATATTAAAGGACTTT<br>TAATTTTAAGGCCTGTAGCTGATAAAAGATGAACGTGAATTCTCAGACCTGGTCTCTGGGTCTGCAAATC<br>TTTCACCTCCTATGTTTTTGGTTTTGCAAGAGGCGGGTTACTTCAGGCATTTTGCCTCCTGCAGAAAACT<br>ATTTCTGTTGCCAGATTTAATAAACAGGGCTCTGCTGGCTCCTATAATTTGATGAAGGAGAAAAAATTCT<br>CAGAAGGGCACTAGGTTTGTGTTTTGTTTTGTTTTTGGTTCGTACCCAATGGCTTCCAAAAATACCCAGG<br>CCTTATCTTTATTGGCTCTTCCAGAAGTCCAGACAAATTTGACGGGCAGCTCACTTATCAGGGGGAGCCT<br>GCGCAGGGGAGATGCGGGCCTCCCCTCCTCCCGGTCTGACGGGGGTCTTTCGCAAGAGGTGGTGCGTGGT<br>CATAAAGTAATAGTAATGATAATAATAATAGGACCTTCTGCAGCCTCCTTCAGCAGGGAAAGGAGGTGCT<br>GGTAGCTGGAAACTGCTGGTGGAAGCCTAGTAACTGCTCCCTCCTGTCACCAGAACTGTGTTTCCAACCT<br>TCTCTTTTTTCTCTCTCTGCACCCCCTCCCATCTGTCTTTCTCTTTCCTTCTTGTCCTTAGAGCAGGA<br>CCCAGAGCGGTCACAGGGCCCTGGGCTCACCATGGCCGACGGAGACGAGGGCTTTGGCCTGGCTCACACA<br>CCCCTGGAACCAGATTCAAAGGATCTACCCTGTGACTCAAAACCCGAGGTGGGCTAGGGGCCCCCAGCA<br>AGTCCCCGTCGTCCCCGCAGGCGCGCCTTCACCCAGCAGGTAAGAAGACCAGAGCCTCTCTTTTAGGTGCT<br>TGGGGGAGCCCAGGGCTTGTAATTGTCCCTTTTCTTTTTTATTCCTCCTCAATCCCACCTTTCTCTGCGT<br>GCCTCCCTAACTGCCAGGATACTCTGATTCACTTTATTGTGAAGATGAATCTTTCTGGCCAGAGGACCTT<br>TGAAATACATTGAAGTTGTTAGGGGAGCCTTAATGATCTGACTCTTTGGGGCCAGTGAACAATGGCCCAG<br>ATCGTTCCTTTCCTGCTGCACTAGGTGTAAACTCGGCCTGAACGCCTCATTAAGGGCTGGGTCAGCGGCC<br>GCTTCAGGCCAGTATGAGCGATGGCTTGACCCCTCTTCAGATCTTTCGTAGCCTTCGCCTCCGCCCGCCT |

| Sequences |
| --- |
| CCTCCGTGCCGCCGCCCAGCCCCGTGCGCAGCCCCATTTGTCTGGCGGGCCGGAGCCTGGAGGGCTGGTG |
| CAGCCGGACCGGCGGGTGGCGAGGAGTGCGCAGGGCTTGGCTGCCAGGGTGCGGGCAGCCGCGGGCTCGC |
| CTGGCTGGAAGCTGGCCTTGGCCGACGATGAACCCTCGCCTCTCGCTCTGCGCCCTTCACCAGGGTGCCC |
| TGGGCGATTAAGGCATCGTCTGAAGAAGCTTGATGATTTTAAAATAGGGTGTCGGGTGGTTGGAAGCGGG |
| GTGTCTTGGCCAAAAGAGAGGGTTGCGCGTAGCTAAAAGCGTCTATGGGATTTCGATGTCCTTCCTGGC |
| TTTTCATTGCTTCTCTCCTTTGCCCTTCACGTCTCAGAAAGATGCGAGTATATTTATAGAGAAGTGGCTA |
| GCAGTGGGCCCGCAGTTTCAGAAACTCAGAGGTTTTCTTTCACAGAAAAACGTATCTACTTATTCGACGT |
| CTCCAAATTATTGCAAAACGAAAACTTTGCATATAATTTTTTGGCCTTGGCTTTGTAAAATAACTTATAG |
| TTGAAAGTGGAAATGTTAAATCGCTGTGCCCATAATCAGAATAGCTTGACGTGAACGAAGCTCGATGTGA |
| GGAGGGCCTAGGAGTTGCGTTAATATAGACATTTGTGAATTCACTTTTGTTCGGGACTGGGGGAAATTAT |
| TCTAATATGGAAACATTAAAAAAAATTAAAACTGCACCTAGGTCTATATAGGCAATGCCATGGTGAGAAT |
| AAACATGCATGTGTACAGTGTTTGCACATCTCTAGGTTTTCGTGTGGGGACATATTGATGTCTACCTAAG |
| AATATCCTGACTGGTTTTTTTTTTTTTTTGAGATTGAGGTTGTCTTTTTTTGTTTGTTTCTTTTTTC |
| TTTTAGCTGCCTCTTGGCTAAATCAGATTAAGATTGGTCCCATTTTTTCTCAGCCCCATCCTCCCTATGC |
| AGATTCTGGAACACCCTGATGGTTGAGGTTTTCCCTAGCCTTTTGTTGGCATTCGGAGACAGCTCTGCAT |
| TGTACGTGTGGGGGGTTAAGACCTCTCTCCGACCAAGCATACAGAGGGATTCCCGGGCAAGAGCTATGGG |
| TGCTTCAGAGCCCAGATGCTGCAGCAGTGAACTGGGGGCAGTTTTCAGGCTATGAGCCCACTGGCTCCTG |
| GCGGAAGGAGGAGAGATCTCTCTGTGTTTTCGGGGAGTTTGAAGAAGGAAGGCTCATTGCCTCGAGGGCT |
| TATCTGTGTGACTCTTCTCTCCTTCCTATAGGGCATGGAAGGGATCAAGGTGTTTCTCCATGAAAGAGAA |
| CTGTGGCTGAAATTTCACGAAGTGGGCACAGAAATGATCATAACCAAGGCTGGCAGGTGAGATGGTCACC |
| TCTGTGGAGGAGGCATACGGAACTTGTGGGAGAGATGAGGAGAAAGTTGATGTGGGAGACCAGAGAAAG |
| GAGGGGAGAGAGAGAAGGGGGGAGAGAGAGAGAATGAGGGAGAGAAAGAAAAPGAATGTATTTTGTTAGA |
| CTCGATTCTGGTTAAAGAGTCACGGAGATTTCCTCCAGCCATCTCCATCAGTGGGGTGGTGGGAATATCT |
| AAAAGGTTAAACCCTGGAAACTGGGTGTTTCTTCCACCTGGTATATAAGAAGAATCAAGAGCTAGAGAGG |
| TTGTGCTATCTGGATGGGTCAGTAACCAGAGGTGGGAGAACGAACGGCAGAACAGAGAGGGGCACAGACA |
| CACAGAGATGACACTGGGCTTTGGATTTCCTGGGATCTCAGGCTTGATTCCTTCCCACCCTCTCTGACCT |
| TGGAGTGGGTCCAGAGTCTCACCGGATCACCAAACTCGGGATCCTTGAATGTATTCGCTACCTCTTTCAT |
| TGTTTATAGAAAGCAGGCAAAGCCTTTGAAACTGAACCAGGGCTGCCGGGGCTCTATATACAGACACCG |
| ATAAACAGTTTCGTCAAGCACACTCACCCTCTTAAAAGCTCGCTGAGTTTTAGTCAGAAATGCGAGACTTC |
| TGGCGGAGGGGGTGGGAGGGTTTGTGCAGCTCCGTATCTCAGCGTGTCAGTGTGTCCGGCCATGCGCCCA |
| GGCCCGGACAGCTTCGCCACATCCCTGCTGGTGCTGGACAGGCCCTCCGAGTCCCTAAGGGCAGAAAGT |
| CCCAGTCTGGTGCAGGCTGGCGGAAGAGCCGGTAGGCCCAAGCCACCGACAGTGCGAAGGGGGCGGGTGG |
| AGCTGCCTCGCCAGACGCCCACCCCTTCTCCAGCCCAAGCCTCCCGCAATAAACTGACAACAGTGACATT |
| TATTATTATTTGAAATTAAACAATGGCTGCTCCCCGTTCGGCCCGCGTGAACTAGGAGGCGCGTTCTGT |
| TTATACCAAAGAACTAAGGTCCTCTTCCTATTCCGCCGGGGAACGAAAGACGCGGCCAGGGCCTCGTTT |
| TCCCCCCATCCTGAGCGGCAGGGATTTAACTATAAAAGGCCTGCGAAGCCTTCAGCGCCTCCGCCTCCAG |
| GCGCGCTAGCTAGGGCAGATAAACACCGCGAGGCAAGGCTCCAAGGGCAGAGGGAGAGGGCTCCGCTCAC |
| CCCTTCCCGCCATCCCAGAGCGAGCCAGGTTCCAGCAACGGGTCCTTTGGCCCCGGCCAGCCTTAGGAAG |
| GCGTGCTGGCCGGGGGAGCCCTCCTCCCAAGGTGGGATGGAGATGGGGAGGGCGCCGGTGCGCGGAGAAG |
| GAGTGGGCTCAGCGGGACCGCGCAACCGCCTTCCACCCACCCGATCCTGCGCAGGGCAGAGTCTTTCTG |
| AAATGAGATTTCTTTGCAGAGGGCCCAAGCGTTTAGACTCTTCTCCCAGGAAGAGCGCCAGGCGCCTTGG |
| AGACGTTATTGGGCATTTAGGGATAAATTCCTGCGGGAGAGGAGACTCTTATCAGAGGTCACACACCTTG |
| CGGGTGGAAGACTGAAACCCCAGCGCAAGGTGTGTGGGTACCCATGCGCGGTTACAGTCCTAGGGCGCAC |
| CCACCTTTGTGCCCACGTGACACGTAGCGCTGGGCATAGCGGCCAAATGTACCTGGCTGGGCGGAGGAAGC |
| TAACTTTTTTTTTTTTTTAACCGAATAAGCCTTTTCCTGCCCCCAGATAAACAGAGTAGGTGTCTGGTT |
| CTGAAATGAGCATTCAGCAACGGTTTAAATGTGGGGTCCCTTTCAGGGTTTCTTCAAAACCAGTCTTTAG |
| AAGCCCTCACCTCTTGCTTTCTATTTCCTCCTATAGACAGGCATAGTCCTAGCCTGCTTTTCTCATCGCT |
| TGGCCCTTCTCCTCTCCATAATTTGATGGGAAACCTGGATTGGATCTTGGCAAGAGCAGGACAGGGGCTA |
| CTTTTCTCTTCCACGTTTCTGAAAAGGTGGAGTCTTCAGAATATTTTCATTAATTCCCTCCCATCTCTGT |
| CTCTGTCCTCCCACCTCTCCCGTGTCTCCTAGGCGGATGTTTCCCAGTTACAAAGTGAAGGTGACTGGCC |
| TTAATCCCAAAACCAAGTACATTCTCCTTATGGACATCGTTCCTGCCGATGACCACAGATACAAGTTCGC |
| CGATAATAAATGGTAGGCACCAGTGCTGGCAGGTGGGAAGGCAGGGAGGAATATGCAAACCAAACTTCC |
| CTCTCCCCCCGAACCAATAAACATTTTTTGGTGCTCGTCCTGTGTGCTAGAAGTTTTTGCTGCCCATTC |
| CACTACATCCTCCTGACCTCACCAAGAAGAAATAAATAGCAGTCATTAGCCCCCATTTTATAGATGAGAA |
| AACCGAGGCTTAGAGGAAGGAAAGAGCTGATAAACATCTGTTCCTGCACCAGTGGGTTGTGGATTTTTAA |
| AAAGGGTATTGTTACTAAGCATTGGAGCTATTCTCAGGGCATAAACCATTAACAGTTATTTTTTATGAG |
| TTACCTGCTTTGAACATGCCTTTTTATGAAATTGCAAAATCGGCCCGGGGTATTTGAGTTAAACAGGCA |
| AGAGAAAAGAGGCTCATTCCTTGGGTACATTGCTCCCGAGGCTGCTAAGAGTCAGAGGCTTGAAGACGAA |
| GCCCACCCCCCACCTTTGAAAGCCCACAAGGCATTTTCCCAAAACTTTCTTGCACACACAGGCTTCCAG |
| AACCTGCCAGTTTTCATGGGCAGAGAGATGCTTTGAGGCCAGGCTTTCTGGGCATCTGGCATTGCAGAT |
| GTCTGAGCAAGACTTGGGGGTCAGGCCATTTTCAGATCATTCTTATATTCAGCAGCTCTCACCTGGTGCA |
| AGAACCAGGCAGCCGCAAGGTGCGCTAAGACTAGGCGGGTGGTACCTCTCCTTGGTCTAGGTCTGTGACA |
| GGCAAAGCGGAGCCTGCCATGCCGGGCCGCCTCTACGTGCACCCGGACTCGCCGGCCACTGGAGCGCATT |
| GGATGCGGCAGCTCGTCTCCTTCCAGAAACTCAAGCTCACCAACAACCACCTGGACCCGTTTGGGCACGT |
| GAGTACCTCGTGCAGCCCTTCCTTTTGTATCTTCAGGCCCGTGCCTTCTCTTTCTCACCTGCCCTCTTCC |
| CCCCCCGCCCCACTCCCTTCTCCAGGAGTTTCTTTCTCTTTCGGCTCCTCGTGCCTACCCATGCTTCT |
| TTTTGTGCTCCATTTCACCTACGTTGACTTTTTCTCTCAGCTTTCTTGACCTGGTCTTCTTGTCCCC |
| TTTCTTTTCCTCTTCCTCATCTCTCTTTCCATTTCTTTTATTTCTTGCACCTTCTAACGCTTCCTCTCTG |
| TCTCCACCTCTCTCCTACTTCGACCTCTGCTCCTGGCAGTCCTCCCTGTGGTCCATGCTCTGGGTGTGTC |
| TTTCCTGGGGCTCATCCTGCATCCCTGCTACCAGCCCCCAACCCTTCCGCCTTTGCTGAGGGACAGGGTC |
| GTGGGGGTGACTAAAGCTGTTCCTTCCGGGCCTGGAATTCCTGTTTGTTCAGTCCCATCTGTGATTAGAG |
| GCAGGGGATGTGTTTCGGTCCTGCAGAAAACATGGGCCCTCTAGCTCAGCAGGTACTCAGCACAGACCA |
| CAGAGTCTGGACCACTGGCGGGAGCCATAGACCTTACCTGCCTCCTTCCAAATCCTGGGATGGTATTTTG |
| GGGATGTTACAGCTGCAAGGAAGACCCTAGGTCCTCTGTTTCCTCTTTTACAAATGGGGAAACCAACCCA |
| CTAGGGGCAAACTCCGGAACCTATGTCCCCTTTAGCTCAATACTCTTGGGTTTATCTGTTTTTTTCCAAC |
| TTCCAGCTCTCCCCAGCTCCTCCCACCATGCTCAGAGCAGACAAACCCAGATCAGGGTCCTACACCTGGA |
| ATCTGAACTGGCCCCAAGAGAGAGGGGCCTGGTGAACTGACTGAAACTGCAGGATTTGGAGCATGCCCCC |

-continued

Sequences

CTCCCCCAAGAGAGTGTGTAGGTTCTAGCAGGTTCTCCATAGGGTATGACCCTCTCTTCCCCAAGGAAAA
AGAATAGAACACTGATTTAGGGGCAAATGTCCCTAAATCTCTTCATTGGAAAGAATCACCAGGACAGAAC
AGTGTTTTCAAAACCTTAGTTTAATGATTCCATGTACAAATGGGCTTGTTTGTCTTAGGGTATTTGATCC
TTATAGCAGCCTAAAGAGAAGGATGGAAATGCCCACACATCTTTGCAATTAGGAGTCCAGCAGAAGGAAG
GTGACTTGCCTCAGGTCATATGGCTTGCATTTGGGAACAGGAATTTGAGGCTAGGTTTCTCTAATTCCAG
AGAAGTGGTCTCTGTCCTGCCACTTGGTCTCTTTATAGAGAATCGACAGACAAACCCTGTTCCCCAGTTT
GGGGATGTGAGGAGACTGGATGAGAATGCATTTAACCAGGAAGTCGGCCAGTTAGTGAGGGTCCAAATGA
GAAATCTGCTTTTTTTTGGTGGGGCTTTGGGACTGATGCACCAAGCCTGCAGGGTCCCAGCTGCAAAGAG
GACCACGAACTGCCACTGATGCGTTCAGTTTGGCTCCACATGTGGTTGGTGTGAGATTGGACTGCTGGCC
ACTGGGGAAGAGGGAAGGAAGGCAGGCCCCTTCTGTTTCCCCGCAGTAAGAAGGGAGCAAAGGGGACAGA
TGGGGCGGGCCATTGTGTGTGGGGGGCTTTCTAGGCAAGATGCAGGGCCTCCTTTGCATTTAAACTGAGG
TGTTTTGCCTGCAGTGGCCAGTTTGGGGGGCACCCCAGCCCACAGATGTGACCTCCAACTTGTGTGGGCG
TTGGCTGGTGGGTAGTGCCGTGTACCTGTGGATGCTGAGTGGATGCTTTAGGTTAAGTGCTGGAACCATT
TTATAAAGGTCCCAGGTGCATGTCCCTTTATGGGGGCCTCCTGGAACCTGGGTGCTGGGAAGCACGACTG
TCCTCCATCCCATCCCTGATCCTTAGCCTTCCCTCTGCGGCCCTGGGTATGCCTTTGGCTTTCGCGCTGGG
GTGGACGCCTGGGGAAGGCGTATGCACAGCCCCTCAACCGAGTCTGAGGCGCATCTGAGAGTTTCGGGTC
CTTCTGCGCCGGCGGACTAGGGAACCGTGTTCTGAGCTCCTCCGGACTCCCCAGCTGCCGCGCATTCCCA
CCCGGACTTTGAGTCCAGAGCTGCCCTAATGAAATTAAGGGCCATTAGATCGTCTTCGCGCTGATGTCTC
CACACTGTCCCCGGCCGTCAAAGCAATTTGGCTAAGCCGGGACGATGGCCGCGCCGGCCGGGGGCTGCGG
CGGCCCGCGGGGCCCCGCTGCGTCTCTCTGTCGCCACGCCGCCCGGGTCGGCGTCGCTATCGGCAGGGA
GGCGACCGGGCGCGGCGGCCGGAGATTAGAGCCGAGCAGCCCGGGTCGGGGAGCCCCGGGGTCCCGAGC
TTTCCCCCCCTCCCCGGCCGGGTCGGGCCGCGCCGCGCCGCTCTCCTCCCCCTCCCCCAGGCGGATC
TCAAGGGTTGGCCCTAGAACCCTGCCGCGGGTCGGTCATCGATGCAAATAATCGAAGCACGGAGACTA
CTCCCGCCGTTCAGTTTGCGGTCCGGGGAAAAAGCAGGCCAGGTTTTCATCTAGGGAAACGCGGCAGTT
CCTCCATTCAGTGGATATAGATCAGAACGTTTTGATAAATACTAGCGATACCAGCCTCCCAGGATCATCA
AAAGCAAAGTGTCATCAGAACCACAAACTCGGTTTTATTAGTAAGGATGTTCATCTTCTCTGGATAGTTC
TGCTCCAGCGAGAATGTGGTGCCTGCAGGGTCCCTGCTGATATTGACAATGGTGGTTGTACTAATAGTAC
TGCTACAGCACTGAGACCCCGTTTGTCTTCAGGACTCTTCTCTAACCATGGAAGATAGGAAGGAAGGA
GAAAACATTCCCCCCAAAGGAGATGCCGCAGTTCTGTCTGGGGCCAAGTCTGGAGATAATTCTGATTGT
GGATCCTGAAATGTTGTAAAGTTGGAGGAAGGGAATGCCAAGGGCAGCCAGGCTTCGTTCCATATTAGG
GGTGGGGGTGCTTCCTTCTCCTCCCCCATCACACATCCTTAGAAGCCCCCTCCCCACAATTTTTCTCTC
TTTTTCATTGACTCCACTTTGCACATTCTCCAAAGACCAAACCTGTGATTTCTATTCCAGTTCTGCAAAT
GCTTGGTCTTTTCCTTTGCATCTCTTTGAGCTTTTTTTGGGGGGGGATTCTTTGTATGTATTTTTGTTT
ATGTATTTGTTTCTTCTCCCCTTTCATTCCAAAACTGTTGCCCAGAGAACCTACTGTATAGCACAGGAAA
ATCTACTCAATAGTTCGTAATAACCTATGTGGGAAAAAGTGGATATATTTATATCCACTCTTTGCTGT
GGTCCTGAAAGTAATACTGTAAGTCAACTCAACTCCAATAAAATTAAAAAAAGACAAAAAAGGA
TACACAGCAAACAAACAAAACAAAAAACCCCCAAGTTATTGCCCAGGCTTTCTTGGAGGACACCAGTTC
CTTGTCCCAAAATTGCTTCACTCCCACTGCAGGGGGTGGGGTGTTGAGGGGGTAGGGAGGTTGGGGGTGG
GCAGTGCCCTATGCAGGGAGTTAATTTATTAAGCAAACTTTATTAAGAATTCTGATTTACTGCCCTGTGT
GCTTTGGGTAGATTCCTGGAATATTACCCTGGCTTTTTCAGATGGAAATTGTCATTTTTGAAATGTTTCT
TTTTAATGAAATCACTGGCTTCTTTTCAAAAACAGGGGAAAAAAAATCAGACCTTTTTTCAAGAGCCTAT
ATAAGGAATCTAATTTTGGGGTGGAGAGTGGGGTTTTATGGAAACAAAGGGGTTTTGATTTTCCTTACAA
TCTCATTTTCTTTATTATTTTTAGATTATTCTAAATTCCATGCACAAATACCAGCCCAGATTACACATCG
TGAAAGCGGACGAAAATAATGGATTTGGCTCAAAAAATACTGCATTCTGTACCCACGTCTTTCCTGAGAC
AGCGTTTATTGCAGTGACTTCCTACCAGAACCACAAGGTAAGCCCAGTACCCAGGAATCTGCCAACAGGG
TGGGGGTGGGGAACCAGCTTGTTTGCCGGAAGCTGCAGGGGTCTCTTGCTAAAACCTTAAGCTTTATGGG
TACCTTTATTCCTCAGCACAGCAGGCACCAACTGCTACTCCGGGGGCTGGGGCAGGGACTGAGCTGCAGC
CTAAGGGTCGAAGCTGTTTGTACTGCATTCACGGAGTTGGCACAAAACACACACACACGCACACACCAGG
TGGAAACAAAATTGTCAAACTAAAGATGACCACATGGCATCAATGCATACTGAGATGCAACAGGAAGGC
ATCCCAATGCGCTGAAATGATCAGTGGATAGAAACACCTTTGCATGGGCTGGCTCTGTACTCTTAGGTGG
GGGCCAGGTGCCACCCTCCTGGGGCCACCTTTTCTCTTGGGATCAGTCTCCTCCTCTCCACTCTGCCTTT
TGGATGCATTTCAACTCCAGTTGGGACAGATAGCACAGTTGCTAGACATCTTGAGCTTGGATTTTCCCAG
ATGCTCCCCTCATTGTTTCAGCAATTCCTGACCCAAGACCACATACTCAAGCAAGGTGGGTGTTGCTGAA
ACAAAACCAAAACCAAAAAAAAAAACAAAAAACCAGCAACCTGGATCACAGCTCTGGGGACTCAGACAAGA
TCCTGCAAACACACAGCTTGATGAAGGGAGGCGTGCCTGCGGCCAGTGCATCCTTTGGTGGCTGCACTAT
AGGGTAGTGGGGGATGGTACAGATGGCTTGTGTCACCGTCAGAACCCCATGCTGTTCGAAATCCAGGCC
CCCATTTGGGCATTCAGAGCTTGACAATGGTATTGGTATACGTGGTGCGCGAAGCGAGCACTTGACAA
TGGTATTGGAACAGGGTGCCCCGTAATCACAGGTTGGGGGGAGTAACTTTTATTATTGCTCAGGAGAAAG
GGCTTGTCTTGACTTGTCACAGTTCATGTCTGTTCTTTAGAAACCCGGGTGCACGTGGATTCATTTTATT
GGAGGGAGGGCAGCGCTGAATGATTCCTAAGACTTGTTAGGGAAAGATCTGGAATCTGGAAAGGCAAGAT
ACAGGGGCTGGGCAGGGGCCATTGCCACTGTGGGTTGTAGACTGTTAGGAGTCTTATGAAGTGATTTGGG
GTTAGAAGGCTGTGAGAGGGGAAAGTTGAGGGGGGTGGTCCATATGCGATCAGTGAAGGCAAATCACGTG
GACCACTTACCGAGATGGCCATGGGGATGGTGTGCCCTCCCTCTCCACAGAGCTCATCCCTCCTTACCT
TCGAGGAAAGAATGGGGGTTGGGGGGAAGCCACAGGGGCAGTGGGCCAGGCAGGAGAGGCCAGGGTGGG
GTGAGGGAGGAGCCTAGCATCCTAAAGCCTCCAGTCACCCCTTGAAGGTCATTTCATGCAGGCTGGGCGT
TGGATAATACGCCCCCCCCACCCACAGTGAAGCCAGGGCAGTTACGAAATACTGTGGGTAATCGCCGAA
TTCAGATTGTCAGTGACCAGGCCAAGTCATGATGGATGGTCCCTCCCAGGCCACACGGCCAGTCTGGGAT
CCCAGGCCTCAAGAGAGCTTCCTTTCAGCAGAAAACTCACTCCCCCTACAAATGCAATTAACTTTCTAAA
GGCAAAGAAGGACTTTTCTTTTTAAAGTTCTTCCCGCTCATTGAACCAATAAGAGAAAAAAAAACAAAAAC
GGTAAGGTCAAGTGCCCTGAAAGTTGCAACACCATTTCAGGCTAATTTGAGTTCGGCTGCCAGAAGCCTG
TTTCCTCTATGGCTGCTGTAAACCTATGTTTAACTTTGTGGTGATGGCCACAGCAGGAAAATGGAAAA
ATAGCAACCCGGACTCTCAGTTACATATATATATATATACACATACACACACACACATATGTGTGTAT
ATATATATACATATGCATACACGCACACATATACACATACTGCTTAGTGTCTCTTAGCCCTGACAGAGGG
TCTAAAATAGACAGATCTTTTTTATTCCTGCTAAGAAAACTCAGGTCCATACAGAGGGAACAGAAGTGG
TAGACACCTGAAAGTGACCTGTTAAAGAAACCTGTGGGTGATTGAGGTCCTTTAGGGGAAATTCCTAAGT
TCTATGTAGCTCTAAGATCTTAGGGGTCCATCAGGAGTGGGTCTATCTAGGGGAACACCTGTTCTTTCTA
TTTACAACTTTCTTAAGGCCTGTCACACAATAAATTGCAGTATTTGATGTATTCAGTTGAATAGGTTTGA

| Sequences |
| --- |
| CGTAGGTATACACCTATGAAAGCATCACTGTTCCCACTTATAAACATACACAACACCCCCTAGACTTATA |
| TTTTGAAAAAAGTCTTCTCCAAGGAATATATTTGGTGATCTGTGGGTATGGAGGCGTGCCTGCCCAGTAG |
| GGTGTGTACGTGTGAGTGTGGAACACAATCTAGGAGATTGTGTGCTCATGGGTCTCCAAACG |
| TGAGTCTCCAAATATGCATTTGGCTATATGCAGATGTTGTGGTTTTTGTGTTTTCTTCCAGTTTTATCGG |
| GGTATAAATGATATTCAGCCCTGCATCCATTTAAGATGTACAGTGTCATAATTTGACTTATCTACATCAT |
| GAAATGATGATAGAATGCATTGAGTGGTGGAGATAAATTTGAAGGCCGCAAAGGAATGACTGATTTTCTT |
| TATTGGTTGAGCCAGGGAGCCCAGGTGAACTGTACATACAGGTCTTTTTCTGGTTTTGTTTTGTTTTAG |
| GGCTGCACCAGCAGCATATGGAAGTTCCCAAGCTAGGGGTCAAATTGGAGCTGCAGCTGTCAGCCAACAC |
| CACAGCCACAGCAATGCAGGATCCGGCCGCATCTGAGATCTACACCGCTGTATCCTTAACCCAACTGAGC |
| GAGGCCAGGGATTGAACCTGCATCCTCATGGAGACTATGACAGGTTCTTAACGCCCATGTAGGTCTTTTT |
| AACGCCAGCCCACATCCAGAAGAGGGATTTCCTGGGAGACAGCTTTCAATCACTCTCCCCCAGATGAGGT |
| TTCCCCCACTTTTTTAGTCATTGAATACCAAGGCATTTGATTCGTTTGTCAGGAGAGAAGTCTAATGCGG |
| GGCACTTTCCCAGTTGAATCCAGGCCCCTGCACGCATTCCCTGCACAGATATATGATGTGTGACTTATAT |
| AAGCGGGTCAGGTTAAGTGTGATTTGTGGACTCTGTTTTGTTACTTTATTGTCACACCTGGAAGGAGCGT |
| TGAGATTTCTGACTTCATGGGTAGAAGCCACCTGAGCTCATGAAGGATTATGGTTGAGAGTCTGGAGGCA |
| GACTGCCTGGGTTCAGACCCATTTGACTTGGACAAATTATTTAACTCAGTTTTCCCCATCTGTAAAATGG |
| ATATCAGAAGAGAATTTTTTTGGTATTATCATTGCAAGGATTAAAATGAGATAATTCGTGGAAAGTGTCT |
| CATGCAGAGCCTGGTGCAGAGTCAGGAGAGATTGTTAGTGATGATTCCATTGATTGAGTACTTAACTGAT |
| CCATTGATTAATAGGGCAACTCCATTCAAAATGCAGGTGCTGAAAAACTCTTTGACCACCCTCTTTTAGA |
| ATCTGAAAGATGGAGATTTTGTTTTGTTTTGTTTTTTGGCCACTCCCATGGCATGCAAAAGTTCATCATC |
| CAGGGATCGAACCCAAGTCACAGCAGCAACCGGAGCCACACCAGTGACAATGCTGGGTCCTTAACCCACT |
| GAGCCACCAGGGAACTCCAGAGACTTTTGAATAAGTTCTTATTTTTGAGGTTGAAGTACAACTATACATG |
| TTAGTCTTTGTGGTTTAGTTGGTTCATTCCCTGATCGTGTCGTCAATCCAAGGCCTGTTTGCCCAGTATT |
| ATGCTTTGGATAAGTGCTCGGGGAAAGAAAAGCAGTCTGTGTGATTAAATTGCCAGGACAATTTGGAAGA |
| ATACGAGCCACCAGTTTTTGGTCCAAGGGGCTCAGTGCCTCCAGACTGATCCCTGGATGCAGGTACCAGG |
| TGGCGGCAGGTAAGTGGCAGGGTTCATATGTATACCATGGGGTTCCTAATGACACAGCCTATTTCCTGAG |
| CGCAGCTGTGATCCCAAGCTGGATTTGGGAGTTATTTCCCCAGATGGTTGACAGCTTGAAAAAGATATTT |
| AAATGCTCGAATCTTCCCCAGCGACGTTCACTCTGTGAAACACGTTTTTGTAAGGTTTTCGCTTCAGTTG |
| TCAGCAGCTCTGAGAGCAATCCCTAGAAATATTTAGGTGTTAAAAAAAGGTCACATGGGCATTTCATTTC |
| CCCACTTTTGCAACAATGGCTTTGTATGGCAAGCTTGTCTCTCCCCAATATTAACTTACTTTGCCATTA |
| AAAGGCATTTTCCTCCTGCTTAAATCATTGTGTATGGAGCCTGTATTTATGAGGTACGAGCTTTCTGGTT |
| GGGACCAGGAAATGAACTCCTAATAGAGAGACATAATTAAGATTTTTGGCCCCCGTGAGGTGTTTTTTT |
| TTTTCCCCAAAAGCGAGAATTCACAACAATTATTCTCATTAATTTTTACAACCTCTGTCTCCCTGGTTG |
| GAGCTGGCATTTATATTTGCTTTTCCCCCCCACCCAAACCCCTCCCCGGATATCCGGTTTAATGCTGAT |
| TCCAGGTGTATCGGTTTGTGTGCCTGCGAGTGACTAGTGCCGTATGAGGAAGGGAATTTCATAGAGAGCG |
| TGATAATAAGAGAGGGACAGGAATGAAATAAGAGGAACACTTTCACCTGCCCTGAAGCCTGCAGGTTAA |
| CATTTCTCAGGGGTCGTTCTTATGCCCAGTAGGCATCTACACTCAAATCTACAAAGCAGGACATAGGTAA |
| GATCCACGCATCTAAGTGCACATTTAGCAAATCATGCGTATCCTGTGCCATCATATTTTTGGAAGTTATG |
| GTGATAAGAGCAAGAATCAGGTAGTAGTAGTTAACCTGTTTGAGGTATAAAGAATGGGTTTGAACACAAG |
| ATTTTTGCTGATGAAATACCCAAACCCACCCTTTTCTTTCCTTTTTTATTCTTTCTTTTTAGGGCTATAC |
| CCACGGCATATGGAAGTTCCCAGGCTAGGAGTCGAATTGGAGCTATATATAGCCTTTGGCTTACACCACA |
| GCTATAGCAACGTGGGATCCAAGCCTGGTCTTCGACATAAGCCACAGCTCACAGCAATGCTGGATCCCTG |
| ACCCACTGAGTAAGGCCAGGGATTGAACCGGCATCCTCATGGATACTAGTCGAGTTCATTACCACTGAGC |
| CACAACGGGAACGCCCCTTTTCTTTTTTTCTCAGGGTAATTTTTTTGTTGCAAGATCTCGGTGGAGCAGT |
| AACATCATGGAACAGGCATTAATTCAGCCTCTGATGCCACCCACCCCCTTTTTTGTCTTCAGTATATTCAG |
| AGGTTGGCCTTCTGTCACTGGGTGGATGGGGGTGCAGGGAGCAGGGAAAGAACTCCCTCTACTCCTTTTAA |
| AAAAGATCTAGTTTGTATTTAACTTATGGAGAATCTCCCCCACCTTAAAAAAATGATTTATGGTCATTTG |
| GGTTGCATTTTATTGTCCTAAGAGCCGAGTGAGAAAGCATGTCCTATTAGGTGATGAGCTTTTGGAGTCA |
| AGATAGAACTGGGTTGAGAAGTGTCCATTGCAAGACTGTTTTCCAAAGAGATCTTTATGGACTTGTATC |
| ATCCTGAAGAGCCAGTTCAAAATATGAGAGTTGCAGGAATGGGCAGAGTGGAAAAGATGAGGGAGGAGGG |
| AGGGAGGGATGAAAAGTATTTACATCAGTTTTACTTTTCGGAGCAGCTTAAGGTTCATAGTAAAGTTGAG |
| TGGAAAGTACAGGGGGTTCGTGTGTACTCCTGTCCCCCCCACCCCAGCTTCCTCCACTATCACCATCCCC |
| TGCCAGAGTGGGACATTGGTTAGCATTCGGTGACCCTATACTGACACATCATCACCCAGAGTCTGTCGTT |
| TGCCTTAGGGTTCACGCTTGGTGTTGTACACACTCTGTGGCTTTAGACACATGTATAATGATGCATAGTC |
| ACTGTGCTGTATCTCACAGAATTGTTTCGCTGCCTTAAAAATCCTCTGTGCTTCTCTTGTTTCACCCTTC |
| CCTTCCTTCTGACTCTGGCAACCACTGATCTCTTTGCTGTTTCCCTAATTTTGCCTTTTCCAAAATGTCA |
| TTTGGTTGGAATCATATAACTTTTTTTTTTTCCCCTTTTTGGCATCCCGTTGCCTATGGAGTTCCTG |
| GGCCGGGGGTCAGATTTGAGCTGGGTTGTGACCACATCACAGCTGCGGCAACACCAGGTCCTTAGCCCAC |
| TGAGCCAGGCTGGGGATTGAACATGTGTTCTGGCGCTACAGAGATGCCACCGATCCCATTGAGCCACAGT |
| GAGAACTCCTCCTATAACATTTAAAAAAATGTTAATTTTAGGAGTTCCAGCTATGGCTCAGTGGTAGTGA |
| ACCCGACTAATATCTATGAGGACTCAGGTTTGATCCCCGGCCTTGCTCAGTGGGTTAAGGATCCAGCATT |
| GCTGAGAGCTGTGGTGTAGGTCGAAGATGCCACTCAGATCACGAGTTGCTGTGGCTCTGGCCTAGGCCAG |
| CAGCAGCAGCAGTAGCTGCAGCTCCAATTCAACGACTGGCCCGGGAACTTCCATATGCTGTGGGTGAGGC |
| CCTAACAAAAAAGGAAAAAAATGTTAATTTTACATATATTTTTTTGTGAACTCACACGTACACATATA |
| GTAATTATATGTGTGTGATAGTCTTGGAGTTAGAAGGAAGCTTTATAAGACCATCTCTTCCGGGAAACAG |
| AACATACCAGACTGCTTGCCCCCAAATAGACAATTATGGGGACATTCATTAATTACGTCTAGTTTCCTAA |
| AGGAGCTACTTGGTTTCTCAAAGTCTATAATGATAGTACTAAGGGCAGAGGAAACAGTTCTGTGGGTACT |
| TGAAGATGATGAATCATGGAGAGAAAATTGTTCTTGTTCCAGTTATTTTTCTATTTATTTCTGAGAGAG |
| AGAGAGAGAGAGAGAGGCTTACCCCAGTACCAGTTTAGGTTAAATATTTTTCTGAAAGTGTTGAATTT |
| CCCCTTACAACAAAGAGGAGGCAGGCTGTAGGCTTGGAACTTTCTGTGGGTACCAGCAGAGAGAATTCAA |
| TGTACCTATTTTCTTTCTATCAAATGGCAAAGCTATTCCACTTTGACCTACAGAGAAGTGATATAATTTT |
| TTTTATAAAATAAATTTAAATAAAAATGGCTTGATTTAAATAAATATATTGGCGTTCCCCTTGTGGCTTA |
| GTGGAAATGAATCTGACTAGCATCCATGAGGATGCAGGTTCGATCCCTGGCATTGCTCAGTGGGTTAAGG |
| ATCTGGCTTTGCCTTGAGCTGTGGTGTAGGTTGCAGACACTGTTCGAATCTGGAGTTGCTATGGCAGCTC |
| TGATTGGACCCCTAGCCTGGGAACCTCCATATGCTGTGGGTGCAGCCCTAAAAAACAAAAGACAAAAAA |
| TAAATAAATAAAATAGAGATGCCGTTGGAGTTCTTGTCGTGGCACAGTGGAAACGAATCTGACTA |
| GGAACCAGGAGGTTGCGGGTTCGATCCCCGGCCTCCCTCAAAGTGTTAAGGATCTGGTGTTGCTGTGAGC |

-continued

| Sequences |
| --- |
| TGTGGTGTAGGTCACAGATGTGGCACGGATCCCTCATTGCTGTGGCTGTGGTGTAGGGTGACAGCTGTAG |
| CTCTGAATAGATCCCTAGCCTGGGAACCTCCTTATGCCGCAGGTGCAGCCCTAAAAAGCAAAAAAACAAA |
| AACAAACAAACAAACAAACAAAAACTTCTCTTTAAATAAAAATATTGGAGTTCCCTGGAGGCCTAGCAGT |
| TAAGGATCTAGCATTGTCACTGCTGTGGTGTAGGTGTGATCCCTGGCCCAGGAACTTCTGCATGCTGCAG |
| GAGTGGAAAAAAAAAAAATTATGCAGGCCAGTGGACAGGCCCTGAAGAGATGTGATAATGATGGTAAAG |
| GTGACCTTTGATGAGTGCTGCCCTGGGGTCTCAAAAGTGATCTGATTTATCAAAATTCAATTCATGGAGC |
| TCCTGATGTGGCTCAACGGTAATAAACCCCACTAGTATCTATGAGGATGTGGGTTCCATCCCTGGCCTTG |
| CTTAGTGGGTTAAGGATCTGGTGTTGCTGTGACTGTGGTGTAGGTTGGCGGCTACAGCTCCAATTTGACC |
| CTAGCCTGGGAACTTCCATATGCCAAGGGTGTGGCTCTAAAAAGACCAAAAAAAAAAAAAAGATCAAT |
| TCACACGCAGCTTTTAGGAAGTTCTTTTACCCAGGTCTGCCACTGTATGCTCACACAAACAGAATATGCG |
| TTAATGGTTTCCAGGAAGGTTCTGGGTCTTGAAACTAAAGTGCCAGTTCTATCACTATATTGCAACAAAA |
| AGTTCTAAGAAGAGGGCTCTCTCTTCTTTACCTAGACAATTAAAGAGGTTAGGCTCTGTTTAATATATAT |
| TAGAACTCTAAATGTTAGTGTTTATTAAATTAGACCCCATTTTCCACCTGAGGTAGCAAACCCTATCTGG |
| GAAATTATGAAATAAACATGAAATGAGACATGGTAGGATTTTGAGAGCAATGATCAAGTCCTTCCAAATG |
| GAGATTGCCACGCTGCAGGAAGCCAACACAATGTCAACATGGTACCATTTTCCAAGGGGGAGGGGAGGAC |
| CAAGTGTTGAGGCCTAGATTGTGTTTGAAACACAAAATGCTAAGATTAAAAACAAAACAAAAAAGCCAAT |
| CCAGCCAGAGCAAGGCAGAGTATGACTCCAATTGATGGGCAAACCGAAACCAGGTTATTTTTCCCCCTTT |
| TAAAAGCTGTTTGATCTAGGACATTTTTCAAAGTCTTCTCATGAATGAAGTGGTGGGTCCCATTGATGTG |
| ACTGGCTTAATTTGCTTCTTTGGGTTGCCTGAGGCTGCGTTTCCATGACACTTACTATTAGCCGGGACCC |
| AAGGTAGTCTTGTAAATCATGTGAAAACATCCCTTTCCTCTGCTTTCAGATCACCCAATTAAAGATCGAGA |
| ATAATCCCTTTGCCAAAGGATTCCGGGGCAGCGATGACATGGAACTGCACAGGATGTCAAGGATGCAAAG |
| GTAAGTCAGTTGCTTCCTGGGCTCCCTCCTCTCTGCAGCCACCCCCGCCCTCTGCTCCTCCCCCACCCGT |
| CCCACACAATAACGCAGGTGAGCCGACAGCCACAGAAGACCGGGCACAGAGAAATGGAGCCCTGGTCGCCA |
| TCGTGAACAAGGAGAAAGAGCCTTTTCAATCCCATTTTCTGATAACTTTCCACGTGATCTCCTCGATCAG |
| GCAACTCGGATGGAGCTTGGAGCATGAGATGGGGACAGGGGTGAGGGGGTGAGTAGAAGAGAATTTGATC |
| GGTCTCTGTCGGCCTAGGAAGGAAAGCTACAATTTCCCCCTCTTTCTCCGCTGTCTCTCTCCCTCTCGTG |
| AAGTCCTTCTCGCCTTCTTCCCATAAGTCACAGGCGATGAATGATTTTTCTTTTTGGCAACCGCTCTTGG |
| TTAATGGAAGGGAAGTTAATGGCTTGATTTCCTGGGGGTGATTATGCAGACAGACTCGACACCACATGGT |
| ATCCAGGGCACTGGAGGTTTGGAAGCTGGTGGTAAAAATTGCTTGGTATTTGTACATATCCTGTGGTCAC |
| GGTCGCTGATATGATGAATAGAAGGGGCTGTGGCAAATGGACATAGTGGGAATTTGGTCTGATTTGATTG |
| TTGCCAATTTTGTCGAACATTCCCCTCTACCTCTTGATAGGCTTCCAAAATAACTTACCATATGGCAAGA |
| GAATTAGAAATACATCCTGATCCCTTTGACCAAGAAAGGTCTTTTTCTCCCCCTCTCCCCCTTTTGGTGG |
| GTTTAGTGTTTCAAAATAAAATGAGGTCATTCAGGAGGCTTTTCCTTATCCTTTCTGGAAGACACGAAAA |
| GGGAAAGTTGGGCCGATGGATAGACATGCTCAAAGGAGAACAAGAAGTTTAAGAAAGAGAAAGAGAAAA |
| GGTTGTGGCTTTGTGGTTTTAACGTGAGGTTTAGAAATACATGCCGTGGAAATTGTTTTCAGGTAGCAGG |
| CTTACCAGATCTAATTTTGCATGCTTTTAAAAAAATAAATGTACTGTTATCTTCAGGTGGGACCCGTACA |
| CCACACATGAATCCCTGCCTTCATAACTAGTTTCCTTCATGCTTGTGGATTTGTAAGACGCTTTTTTTGT |
| GTGTGGTGAAAAATAACCAAGTTCTTAAATTATTATTTAAAAACACCTTTGGCCTTACATGTCTACATTT |
| GGAAATTGGAGTTGGGTTTAGTCTTATGGTCACTGGAAAAACTGACAAATATCACAGAAAGCTGAAAGAG |
| ACCAAACTCTTTTTGGCCCTAGTCTTTTGGAGTGCCAAGTTTTTATTTCTATGTTGTCTGTGAGCCCCT |
| CCCCATTCTGATGGCTGTCTGTCATCAGCCATTGATGGACAAAGACCCCTCTCTGTTCTTCTGCAGGTAA |
| AGGTCCAGGCTGTGCAGGGAGGGACTGGTTTCAGCCTGCAACCAAAGGGTTTTTTCCATCTCCCACTTCT |
| TCCCTCCTCCTTCCCACAAGGTCAAGAGCACATGGTTTCATGGGCTTAAGGAGTTATGGATCATCCCTTG |
| AAATTTAATCAGTCACCAGGTCCTGTGGAGTCTACCTTCTTCACATATATATCAGGATTTGCCTACATTC |
| TCCACCCAGGCTGTCTTTTCCAGCCGTCACCATCCTCATCTGCCCTGCCTCCTCACCTCTTGAGACCTG |
| ACTTCAGCTCTGTTCCCATCCAGGACAAACTCCAGGCAGCTGCTAAAGACATCTTTGTAAGACAGATCAG |
| ACACGCTTACTTCACAGCCTAGAACTCTCCCAGGCCTCCTGTGGCCCTCGGCGTCAGGTCCAGACTCCTT |
| TGCGTGGCTGACCACACCCTTCCCATCTGGCCTGGCTGAGCCCCCGAGCTTTCCTCCTCTCCCTTCAGTC |
| ATGCTGAAGGATCTATTCCAAATCTGTCTTCCTCTGTTGTTTTCATTTTTGTTTTTTTAATTTTTTTGTT |
| ATAGTTGATTTACAATGTTGTGTCAATTTCTGCTATACAGCAGAGTAACCCAGTCCTATTCACACACACA |
| CACACACACACACACGTACACACGTGTTCTTTTTCTCACATTATCCTCCAACATGTTCCATCACAAGTGA |
| TTCAGTATAATTCCCTGTGCTATACTAGTTTTTTTTTTTTTTTCCTTTGGCATATGGAGTTCCCAGA |
| CCAGGGATCAGATCCAAGCCATAGCTGCAACCTACACCACAGCAGCAATGCTATATCCTTAACCCAC |
| TGTGTCGGGCCAGGGATTGAACCTGCATTCCAGAGCTCTAGAGAGGCCACTGATCCCATTGAACCAGATT |
| GGAACTCCCTCATTATTTTTTGAGTAAAATAACACCTTTAGTCTGCCTCAGTCTGTCTCCTCTCCCGCAC |
| TTCCCGTGGCCATCTCCTGCCCATCATCACTAAGGCTTCCCTGTAGCTGTCCTTTCTTCCATGAAGCTTC |
| CCTTGGCAGCAGACTTTGTAGTCAGGGTATGTCTGTTCCCAGGAGCCCTCAGGCCAGGGCCTGGTGCTCT |
| GGAAGCTGGTTGGACAGATGATGGCCGTGGAAGGATAGACAGGTGGGAGGTACAGGTGTTTGAGAGCTC |
| CGCTCCCCTCAACACAGCTGAACAACACAGCTGGCTAGATGTTGAGGCAGATGACTCTACTCTGATCTGA |
| ACTGGTGCCCTAACCATCTCCTAGTTGTTGCGGATTGGCCGAGGTCTCTTTCCTGGATAGGCACTTGGAG |
| ATGGAAGGAAGGTAGGTTGGTTGGTCTTCAGTAGAAACTCAGGGATTAACGTGTTGGATCAGAACGCCCA |
| GCCTCAGAGTCACATGGATCTTTGTGGCCGCCTTAGGAGTTGCCTTGGAGAACACAAGGGCTGAACTAAC |
| TGTTCACCAGGCTGAGCGAGTGGACAGGGTCGATTGCCCGGTTCTTTAGAGGTGGCCCCTGGGGAAGAGA |
| GCGAGCAAAGCAGAGAGCCTCCAAGAAGCTTTGGAGTCAGACAAAGGTGGGTCCCATCCTTGCCCTGCAC |
| TTATCAGCACATGACCTTGGCCAAGGGATTTCACCTCACAGAGCTTCAGTATCCTCATCTGTAAAATGGA |
| CATAAATAAACATAGTTTCACTTTCTGGGGGTTCTTGTAAGAATTATCTAAACAGTGCTTGGCTCCCAG |
| TCCACCCTCCAAAAAGTGATCTGATTTGGGAGAAAACTCTTCATGCCTCCTAGTTTTGCCCCTGTTCAGA |
| ATTTTTCTTCTGGGCTGTAGTCCCAGCTCCCAAGTTGCAGGAGGCAGTGACAAGTGGGGAAGATGGCCCT |
| CCGGAGACGGCCGTGATAACAGCCTGGCTGGAATGGCAGGCTCACTGTTAATCTTGTAATCCTGTTTCCT |
| GTCCCCCACACACCCGGTGACAGCTGGCTCAGGGAGCAAAGCAGGGGGAATGAAATTTCCTCTAATTCCA |
| ACAATCGGACGAGGGGAGAGGGGAGGGGAGAGGGGTGAGGTTGTGAGGGCTGAGCATTAACTCAAAGT |
| GATCCCACATAAATAACTTTTGGATTAGCTTGGCAAATGTCTGGGCCCTCACCTCCACCCTTCTCTTCAC |
| CCAGCAGTCTGTGATTGGAAGGTGCAGAGGGTGTCTTCATTATTTTCCAACATGTATGCATGGTTTCTGG |
| TGACAGCCACAATAACAGCTTATTATGAAAATGGGGGAGCGAAGGAAAAGCACAGAAGAAATGAAAT |
| CATTTGCAAATCCTGCCTCGAGCCGACTGATTGAAATATGTGCCAAGGTTATTTGGAAAGGTTAATCTGT |
| GGCTTAGAAACATCTTATCCTAAAAACCAATATTTCCCAAATTGCATGCCCCCTCCCCTGGTGACAAATG |
| AGATGATTTCAGAGGGCGCACGCAGACACACAGGCACATCAGATTGATTTCATGGACCTTATTGCTTAGA |

-continued

| Sequences |
|---|
| ATGAGACTAGGTCCTAAGAAAGTAGGGAAAGAAGAAAAGGAGAGAGGGAGGGAGGAGAGTTAAGGCTGAT |
| TATTTAGGGAAAATATTAACCAAAGAGCAGTGGAGCTGGTATGAAGATCTGGAGGCAATTGTCAAGGTGA |
| TGGGCAAATCACAGACATTTGGGAGATACACCTGGGTTCATCCTAATGTGAAAAGTGTGACAGCTTTGCT |
| ATTGTTTGAAATGATCTAGGCCCTGGTTTTTCATAGAACATTGCTTTCTTTGAACTTTGCCTTGAACTTT |
| CAGATGTGCTCAGACAAGTTCTGAACTTCTTAGGAGTCAAAGATGTTAGTGGCGTCAAGGCCAGGGCCAC |
| TGGGGAGGTGGGGAGAGGATGGAGCCGGGCCTTGTGGGATGAATGGGATTTGAGTCTGTTGGAAGGAAGG |
| GTTTTCTGGGTCGGCATCAGGGAAGAAGTGGATAGGGATCTATCTACATGTCTTGGACTTGAGAGGAAGG |
| GTCAGAGTCTAAAGATCTCTGGAAGCTAGGTGGCATGGCACTGTGACAGGGGACACTATGAGGAGGCTCT |
| TCCTAGAAGCACGGGATGCTAGAGATAGAAGGGATCCTAGGAGGCAGCATCTGGACCAACCTGCACCCTT |
| GTGCAGAAGGGGGAAATGTGGCCTGGTGACTCATTTATTTATTTATTTCTGGCCATGCCTATGACATGTG |
| GAAGTTCCCAGGCCAGGGATCGAACCTGTGCCACAGCAGTGACAAGGCCAGATCCTTAATCTGCTGGGCC |
| ACCTAGGGAGGTCTTATTTCTTCACTCTTTGATCCTTGGATCTGTTGCTTTCCTCTTAAGCTCACATGCA |
| TGTATTCAGTGCCTGTTCCATGTTAAGTCCTGGGGCTGCAAAAGGTAAATCCAGACAGCGAGCGAGGGGC |
| AGGGGGCACGGATGGTCCAGCAGGCTCTGGAGCTGGGGTCCAGGCCACCACACTGATTAGGCAGGGGCT |
| CCTCTACTTCACTGAGCTTCTCCTTCCTCCTCTGTAAAATGGGGGATAATTATAGAACCTCCCTCCAGGG |
| CTGTTGCATGGGTGAGAGGAGGTAATGTGTGTGTCCTAATTATTACTATTGCTATGAAACAATTCACTCC |
| TAAATTTCAAGTGGACCTGCTGCGAAACTCTGGGCTTGCCGTCAGCTCTGTGTGGGTGAGACTTGAAATC |
| TAGGACAGCCAGCACTCCTGTACCCAGCATCCATGTCTCTGCAGTCCTTCCATGAGGAGCTCAGAGGCCA |
| TCACAGGGCTCTAGATTTCATCCAGTTGTAGCCTGCCAGCCCTCAGGAATGCTCTCAAAATACTACTTGT |
| GCTGGAAAGGCCAGGCGTCACTCACCATCACTGTGTGTGAAGGGAAGCCTTGGGGAGCACTTTGGCTTCC |
| CTTGTGATGTGTGGGTCTGGAATTTGAAGCGGGTACTTCTGGGTGGTTGTTGCTTGCTGTCAGGTGTTGG |
| TGGAAGTGGCAGGTAGTTGAAGTCCAGGCAAGGCTGGATGCCCAGGATGGTCCACCCCACCACCCGTGGT |
| TGGCACTGGCTCCTGGCTGGGAGCCCATCTGGGTTGCCCAAGAGGCCTGTCCAGCATGGCAGGCTCAAGG |
| GAGAGGGAGTCCCTGCTTGGTTGGAGTCGCAGGGCCTTTGCTCACTTGACCTTGGGAGGCTGTAGTGTCT |
| CTTCTGCTGCATTCTGTTGGCTGAACAGGGCTCACTAAGTGGGCCCAGATTCCAGGAGGAGAATAGACAT |
| CCCTCCTCTAGATAGAAGGGGAGCCAAAGAGTAGGCCTGCATTTTTTTTAAATTTAAATGTATTATTTA |
| AAAAATTTTATGGCTGCAGCTATGGCATATAGAAGCTCCTGGGCCAGGGATTGAACCCGAGCTGTAGTTG |
| TGACTTGTGCTGGAACTTCAGCAATGCTGGATCCTTTAACGCACTGTACTGGGCTGGGGTATCAAACCCA |
| TGCTTCTGCAGTGACATGAGCCACTGCAATTGGATTCTTAACCCCCTGTACCACAGTGAGAACTTCTGAG |
| CCCACATGTGTTAATACTGCCCCACCCATGTGCAGGAGCTCCTGGTGCGGTCCCTGGCCCAGAGTGATGCT |
| GGAGCATGTCAGGTGTTGAGATGGGATCTGTGCCCTGGTGAAGCTAGAGGCCAGGTTGACCTGCCCTAGG |
| GCCACACAACCAGTCAAAGTGCAGAGGCTGGGCTGTGAGCTTGGGCTTCTTCCAGATGGAGAAATCCCC |
| TGTCTGCCCTGCCAGGTGGCCACTGGCTTTGGAATGACAGACAAGTAGGCAGAGGGCTCCCCCCAGTAGG |
| CAGAGTAGGCAGAGTAGGCAGAGTGCTCCCCCACGCCCCGCACCCCAGCAGTTCTGGCTTTAATTCATG |
| TAGCATGGCCTCAAGCAATGCCTGGTCTTTCCATCAGACACGGCATTTATGGAGCGTTGTCAGGGGCTAG |
| CAGAGTGTAGGGTGATGGCCTCAGAGCTCTTCATGGAGGAATGCGAGGCGGCCTCCACCTCCTCAACCTTT |
| TACAGGACTGCCGATGCCTTGGCAGGAAGTGGTCTCTGGGGCTGGGGTACCCAGAGTTGCTGTTCAGCTG |
| ACCTGGATCTTGAGCCCCCGCAAGCAGAGACAGATAGGAAAGCTTAGAGCCCTGAATGTCCCAGGCAGG |
| GTAAATAGGTTGAGGACATCTCTACCACCCACCTGAGAAACTGGCCATTGTCCCCTCTCCGAAGTGCCTC |
| TGTCACCTCCTCCTCTTCTTCCTCGAGGGTGGGGGCTTCTTAATCGGAATCTAGAATCCCTTTGGAGGAG |
| TTCCCATCCATGGCTCAGTGGTTAACGAATCTGATTAGGAACCATGAGGTTGCGGGTTTGATCCCTGGCCT |
| TGCTCAGTGGGTTAAGGATCTGGCGTTGCTGTGAGCTGTGGTGTAGGTCGCAGACGCGACTCGGATCCCG |
| AGTTGCTGTAGCTCTGATGTAGGTCGGCAGCTACAGCTCTGATTGGACCCCTAGCCTGGGAACCTCCATA |
| TGCTGCAGGAGCGGCCCAAGAAATGGCAAAAAAGACAAAAAAAAATTAAGATCCCTTTGGAAAATCCAAT |
| TAAAGCAAGGAACTCTGAAAAAACTCACAACATATAAGTAGAAGGAAAATGTCAAACAATGTCAAGGGATT |
| CATAGGGTCCGGGACCCTTGACAGGTTAAAATCATTCTATTGGAGCCATCCCTCTGGTTTCCAGCCCTTC |
| CTTCCTGATTTTAAATGCATGTTCAGCTCCTTAACCTCACTGGTCAGTTTTCAAGTGGGAGGCTTGGTGC |
| TCTGGCGTTCTTATGCTTGAGGTTAAAGGTAACGGGCAGGTCCAATTAAGGAGGTGTGATTTCCAAAACC |
| ATATTCTGGAGACGGCATTAACTCCCCACTCCTCGCTGTTCTTTTGGCTATAGGCATGTGGCTCCCCCCC |
| CAGAAAAGTGTGAATTTGTGGCAAAGAAGAGGAGGGTTATGTTCGAGAGGCCTAAGCTGTGAGATGGTGC |
| TTTGTCCCAAGGGGTCCCATCTTGGGTCCTGGTTGTCCATCGTGTTCATCATCTTCTAACTTTTCCCAT |
| TTATCTGTCACGCTGTACCCCCGCCCAGCGAACCTCCTCTTCAGGGACAGTGTCTGTGGGCAAATCACA |
| TTAAAGCAGAGTTTCTCAAACTTTTGGCAGACATCACAATTAGCTGGGAATGTTAAAGGAGTGAATTTCT |
| GGGTCTTACCTTCAGGGGTTCTGAATCAGCAGCTCTAGGGAAGGGGTCAGAAGCTGGCCTTTAACAGGTT |
| ATCTGCTGGAGAGGGTCCCCTGGTCACACCTGGATTATCCCTTGCCCCTACAGGACGAACAAAGACATGC |
| AGGTAATGCATGATTTTATTTTTAGGAAATAAAGCACATGTGTTGGGCTGTTGTATAGAAAAGAACATTT |
| TTCTCTACTTGGTGCTAAACTTGAGCTGAACATTAGAAGTACCTGGAGTGTGTTTCAGTGTTTTATTACG |
| AAACATGTAAGACATACAGATAACATAGAATTGTACACTTAGCACCTTTATACCCACTGATCAGGCTCTA |
| CAATTAATATGTTGCTATGTATTTGCTCTACCACACATCCATCCACCAACCTGTCTGTCCATCCATCCAT |
| TCATCCATCCATCCATCCATCCATCCATCCATCCACCCATCCATTCATCCATCCATCCATCCATCCATCC |
| ATCCACCCATCCATTCATCCATCCATCCATCCATCCACCCACCAATCATCCATCCTCTTATTCTTTTCTGAT |
| GCATTTCAAACTCAGTTGCAGACATGAGTCCTTTCACCCATGTGTAATTCAGCATGCATACTATTAACTG |
| GCATCTAAGTTTTCGTTCAAGATTCTCTACTGCAGGTAAAATTTATATACAGTGAAATGTGCGGATCTTA |
| AGTGAACCATTCAGTTCTTGACAAATGTACAAACCTGTGAAACCTAAGCCCTGTCATAAGATAGCTGGGG |
| CCCCTTCACTCCAGCACATTCCTTCATGCCCCCTTCCTAGTTAATTCCTCCTCCCCTCTCTACCAGAAA |
| CAAGCAATATTCTGATTTTTAAATTATGGGTTAGGTTTGTCTGTTATAGAACTTTATGTAAAAGGAATTC |
| ATATAGTGTTTCTCCTTTTGCGTAAGGCCTTTTTTTTTTTCCCTCCTGGAGAGCTTTTAAAACTCCAGT |
| GTCCAGGCTGTATTGCAGAACAGTGGCATCAGTATTAAAAAAAAATTCTCCAGGTAATTACAGTGTCAGC |
| CAAATTTGAGACTCACTTCTCAGGAGAGATTCTCCCATGTCTGCCCATCCCCACCTTAAGCCCTGTCTCT |
| CAATTATCTCATCACAGTAGTTAATGCTATCACGTTGGAAATTTGTTTTGTTTTATTCTTTGTTTTTCT |
| TTTTTTAGGGCTGCACCCTTGGTATATGGAAGTTCCCAGGCTAGGGGTTGAATTGGAGCTACAGCTGCTG |
| GCCTATACCACAGCCACAGCAATGCCAGATCCAAGCCCTGTCTGCAACCTACACCACAGCTCACGGCAAT |
| GCAGGATCCTTAACTCACTGAGTGAGCCCAGGGACTGGGCCTGAATCCTTATGGATACTAGTCGGATTCA |
| TTTCTGCTGCACCACAATGGGAACTCTCAATTTTGTTTTTTTAAGGGGTAAGGCAGAACTCTCAATTTT |
| ATGTTAGTCCCCAGAACATTTAGCATTCCTGAAGAAGTGGTTGCTTTGGGGTGCCTTTGCCAAGGTCATC |
| ATTTCACTGATGGTCACCAGGAGGTCCTTGGCTTAATTCGTCATGACCGGGGGACCCCCCCCCCCCGTGA |
| CTCCCCATGGAACAGAGGAGGCCTTAAGACAATCCCTTGAGTGCAGGAAGCAGTTTCAGAAAGGTCCCTG |

-continued

| Sequences |
| --- |
| TCCCAAGTTAGTCCAGATCCCTCTGGCCTCCAGCTTCCGGAAGGACAGAGAACCAGCCTCAGAAGGCATC |
| TCTTCACCTTCCCGCCCTCCCTCCAAAATTATTAAAAGACACAGAAGTTCCTTCCCATCGTGGTGTGGCA |
| GAAACCAATCCGACTAGGAACCATGAGGTTGCAGGTTTGATCCCTGACCTTGCTCAGTGGGTTAAGGATC |
| TGGCGTGGCCGTGAGCTGTGGCGTAGGTTGCCGACGCAGCTCGGATCTTGCGTTGCTGTGGCTGTGGTGT |
| AGGCCAGCAGCTACAGCTCTGATTGGACCCCTAGCGGGACCTCCATATGCCCTGGGTGCGGCCCTAAAAA |
| GCAAAATAAATAAATAAAATTTTTAAAAAACCAAAATTATTAAAAGATGCAAACAGAAACTACTATTGGA |
| ATTTGTTCTCACTGTGGCCCAGTGGGTTAAGGATCTGATGTTGCCCCAGCTGTGGTAGAAGTCACAGCTG |
| TGGCTCAGATTTGATCCCTGGCCCAGGAACTTTCATGTGCCATGGCTGCAGCCCCACCCCCCAAAAAAG |
| AAAAAAAATAAAACTTACCACCACCAACAAAAAACAAAACTACTAAAACTAAGACATGGTTAAACTCGT |
| TCAAATTGTCAGTTTTATGAGTCTGATCTAAAGTATCGAGCTTTTCCATTTAGTCCTAGATACTTGGTAA |
| TGCTCTTTGACACACTAAGCGCCCATCAAAGGTTTCATCTGTATGGATCTTTCATGGCTGTGGTGTAACA |
| TCCAGCTTTTACCCAGGGGCTCATGATGATACTGCAAAGTGGGCTTTCTTATTCCCATCTGCAGATTGGA |
| GAAACTGAGGCAGATGTCGATGTCGTAACTGTCCATGCAGCTGGTCCAGGACTTTTCTCATGTTGCCAGA |
| GCTGCCTCTGTAGTGTCCCTCAAAACCTTTTTGTGATTCACAGACCCCTCTCAAGTAGCTAATGCAAGGA |
| TGGACCTCTCCCTAGAAAAATGGACAAGCTTCTGTTATCTGATATTAAGGGCGGGGAGGTGGGGGGAGTC |
| ATAGATCAGTTGAAGCCCTTGCAAGGTAAGAACTTGTGCTTCAAAATAGAATGAATGACGTGTGGTTTAT |
| AAGCTGGGGTTTATTGAGCAGTGTGCCCCAACTATATGCTAAACTTTTCAAGCACTGTATCATTCAACCC |
| TCCCAAGAGGCAGTGAGTCTGATCATTCCCATTTTACAAGCAGGAGACCGAGGCTCAGAGAAAGGAAGAA |
| ATTAGCCAACCCCCCAGTGGCCAAGTTGGTAGCTTGGTACCAAAGGAAGGCACATGCATGCTGACCAGTG |
| CCTCAACTCGAAACAACCCCCTGGATATGAACTTAATGTAGGTCCCATTGTGGCGCAGTGGAGACAATCA |
| GACTAGTATCCACGAGGATGAGGGTTCAACCCCTGGCCTTGCTCAGTGGATCGGGGATCCGGCATTGCCA |
| TGAGCTGTGGTGTAGGTTGCAGATGTTGCTCAGATCTGATGTTGCTGTGGCTGTGGCATAGGCAGCAGTT |
| GTAGTTCCTAGCCTGGGAACTTCCACATGCCATGGGTGAGGCCCTAAAAGGCAAAAAAGAGTAGATATT |
| TAATAAGGGAACCCCAAGGTCTCTAACCAGAGTGGTCATAAATAGCAGGTGCTCAGGGCCAGAGAGCTCA |
| GCGTCCCTGAGTTTCTTGTGCCACTCAGATCGCTGGTTGAATCAGTGGTGGGAAATCCACATAACCTCTC |
| TGTGTTCCCCTGGTCTTACCAGCAAGATGGGACAGCCAGTGGTCCCTGTGCTTTCCTCCGGCTTGCTGGC |
| ATGCTGTGAGTTGAGAAACAAAAGGGTCGCGAGGCATTTTGTAGACAAGAAGAGGGAGCGATTATTATTT |
| GCAGAGGTAAACCCGTCTGGGGTGAGCTGCCCCACCTCCCCCTTTCCCCCCTTCCCTCCAGTGTCCACA |
| CCTCTTAGATAACTTCCCCAAGTGTATTAGAAATCAGAAAGGCTCTCCTGGGATTGCCCCCCCCGCTTTT |
| CATTTTAATCACAGATTAAAGTGCTAGTGAGAGGAGGAATTTGCTCCCCGAGAACAGAGATTTTACAGTC |
| CCCAGCCTTGCCCCAGTGTGCTGCTTTAGTTGTTTGAGAGAGACTGCCAGAAACTGAGTAAGCATGGCCA |
| GGGGAAAACAACAACAGAACCTTCCCCCCCGCAGCACCCCCGTACCCCTGCCACCTGCTCCCGTGAAAAG |
| GCCAATTCAGTCGGCCGCGGTGGAAAACATTCTCAGGGGCATTCGTTAGCTGGCAGCGGGCTGCAATGCA |
| GTTTGGCTGTGGATTTCAATATTCCCTTGTAACGTTTTACAACCCAGACCCGGAGACAATGGCGTCATTC |
| ATGGCATCCGCTCACGTGGAACAGAATGTGAGAGCGAGGCAGAGCCGGGGAGAAGCTGGTCTGTCAGCAG |
| CCCTGACACTCAGGGTGAGCTGAGGTACTCAGGGCCCTGGTTGGTTGTCCAGACTGGGCAGAGCATGTCT |
| GTGCCTACAGGATGTGAGTAGAGCTGTTGATACAGCGGAGAGCAGTGGGATTTGTAGGACTGATTGACAG |
| TTTGACCAGTGGAGGTTGATGTTGCCTGCTGTAGCCAATAGCTGACTGTCACCATAGAGGATGCTCTGTG |
| GAACAGAATGGTCGTGTCGCCCAAGCAGCAATGGGAAGGCAACAGTGTCCTGTTATCAAATATACATTAG |
| CAAGAGCATTGGAATAACACCGACCCAGGGTGCAGCTCGGCTTTACCTCTTCTGAGCTGGGTGATCTGGG |
| GCAAGTTGCTTAACCCCTCTGAGCTTCATTTTCTCTAGCTCTAAAGTAAATCTAATCATGCTGATGAAAT |
| GGGATTCTTGCCAGGATCCAATGAGGGAAAGCCTATCAGTCAACCAGCACAGTGGCTGGAACATTAGGAC |
| ACGTGGGAAAAAACAATGTGGCTGGTGAGGAAGAAGATGAGGATGAGGATGGTGATGGCGACAGTGGCGA |
| CTAGGCTGGTGGTGAGAAAACTGTCCCCCGTTGCTGCCCCTCTTCCCAGACACACAAGGGCTTTTCAGCT |
| TTCACTTTAATTCTCTGGTGCCCTGGATTCTTCAAGGATGCTCTCAAACTCTGGAGGAAAAGAGTTCATC |
| TTCTCATCACAGGGATTTGAGAGACTTCGCTGTATTGCTACTCACTGAGTTCCTTTGATTGGTCCAAGAT |
| GAGCCCCGGGAGAATTATCCCAGTGTTGTTTGATGGCTCCATTTTCTTCTCTTTGCCTCTGTAATCCCAT |
| CCTGATTGAGAAGTCACTCCACCCTTCCCGTGCCTCGATTTTGACACCTGTCAGACAGATTGGGGGATGT |
| GGTGTTTCCTACTCCAAGGGAGATACGCTCCATTGACGGTGGGATGAGGTTTCAGGCTCCTCGGGGAGG |
| GAAACGCACTGGGAGGGACAAGTGGTTATGGGGATAATCTGGCTTTCCCACTTCTGTGAGTGTGAGTAAT |
| CAAAAGCAGAATTTGGCCCTTCCAGAGAGCCCTTTTGCAATTTGGCAGTGCCGGAAGGGAGAATTCCACG |
| GAGTCCATTGATACATTCGCTTGTAAATTCCCTCAGCCAACATTTTTTAAGAGTTATTTTCTTTAATTAA |
| AAGAAAATAACCATCCCCATTAAGAATATCAAACTAAATGAACTTTCCCTCTTCCTCTATTGGATCTCTGAC |
| AGCCCGGTACTTGAACTAAACAAGACCTAGATAGAATCGCCAGTGAGATTTGACAACTTTTATGTTTTAT |
| TATTATAATAATTTTTCTTTTTTTTCCATTACGTAGCTTGGGCTGCCAAGCTGGAACGCTAAAGCTAATT |
| TCATTCCTTCCAGCCTCCTGGCCCCAGGGGGAGATTCTGAGTGGTGGGGATGCTCATGACAGCTCCAGCT |
| TTGGTTCTGAGATGGCACAGACCACGGGAAGCTGGGCCAGGGGACCCCAGGGTGGCGGGAGGGTGTCTGT |
| AGCCTCATGGAAACTTGGCTGACTCTCCGTTGTCTCCTGCCTGGTTACTGCGATGTGTTTTCAGATGACA |
| AACAAAGGCAGGGGCCCAGCGTGGAGATCGTCTATATCACTGAGGGGTGGGAGAAGTGGGAGAAGAGCCTT |
| GGGCCCCTGCACCCCTGCACCCCTAAAAGTATATTATGTTTTCAATATCGAAAGACGTCATTAGGAGATT |
| TCTCAAAGTCATTAGGGGACTGTTGGGTCAGAATTCTGGTTGTGTCTCTTTCTGACTGTGTGTGCCAGG |
| CAAGTTACTTAATCCCTCTGGGCCTCAGTTTTCCAATCTGCAAAATGCAGACAAAAGCAATATCCACTTC |
| TTAGGATCACAGAGAGGATGAAGTGGGCTGGTGCCGAGGGCATCCTTCAAAATGTGCTGGGTGTAGTGCT |
| CTTTGTATGTGAGATGATTTCAGGTGTACTCTTTGATTTTAACAGGTGCGAGAGGATCTATAACTAGCAC |
| TACAAACCCCTACTTTAATGGATGTTATTACTCAGAGGGAGGCTAAACTTATTTAGATAAAGAATTAAAT |
| TTTTTTTTTTTTTTTTTGGCCGAACCTGCAGCATCTGGAATTTCCCAGGGCCAGGGATTGAACCTG |
| AGCCACAGCAATGACATTGCAGAGTCGTTAACTGCTAGGCCACCAGGGAACTCCTAGATTAAGAATTAAT |
| GTTAAGGAGTTCCCGTCGTGGCGCAGTGGTTAACGAATCCGACTAGGAACCATGAGGTTGCGGGTTCGGT |
| CCCTGCCCTTGCTCAGTGGGTTAACGATCCGGCGTTGTCGTGAGCTGTGGTGTAGGTTGCAGATGCGGCT |
| CGGATCCCGCATTGCTGTGGCTCTGGCGTAGGCCGGTGGCTACAGCTCTGATTCGACCCCTAGCCTGGGA |
| ACTTCCATATGCCGCGGGAGCGGCCCAAGAAATGGCAAAAAAGAAAAAAAAAAAAAAAAAAAAAGA |
| ATTAGTGTTAATAGTGGAGTAAGTTAAAGAATAGTTGGTCCATGGCAAAAACCACAGCTTAGTTCAGAAT |
| TTTCTGATATATATTTCTTCTAGGGAGGGGTTTTTCCCCTGTTTAGGACCATGAGCCTCTCTGGCAGTCT |
| GGGGAAGCTTATGGATGGGTTACGTCTCAGAATGATATGATTAAATGTGTAAAATAAGATGCCAAGATTG |
| CAAAGGAAACCAATTATATTCAAATATCGTTATCAAAGTCTTTTCTAAATGGCGATATAGCAATAAATGC |
| TCTTAATAAATGTCTTAAGTAACAGGATCTAGTAGCAGGTCGAAAATGACTGTAATTTTGAGGTCGTTTT |
| GAGCATAAATGGCATCTGGAGACACGTACAGCTGCAACGAGAGATGAAATTATTTTGTTTCTGTTGATGA |

-continued

| Sequences |
|---|
| CAGTCGCTAGGGCTGCTAACTCAACTGTGGCTCATTGCCTGCACCCATCACAGAAAGAAATACTAAATTC |
| CAATCCAAGATTAGTGAAAATAAAGACGTCATTTTGGAAATCCAAGTTCACACCCCTCTGTTTTCCCCAA |
| AGTTAAGACCTCCAAGTTGAGGAGACAGGCTCATGGAACTGCTGACTCTGGAGAAATTTTATGGGCTGAA |
| AGCACGAGTCATTTTGTAACTGCAGACACGATGGTTTCTACTCCATGCCAGATACTTTCTAGAGTGCATT |
| GTTGGATGGTTTCAACAATTTTGTGAGATAACTGACTCTCAGAGAGATTAAATGCCTTGTCCAAGATCCC |
| ACAGCGATTAGATGGGAGGGCTGATAGGGAATGCATATTTTCCTGAAGCTCGCTCATACCTTTATTCTTC |
| CCAAGCTACCCTGATTCTTAGATAGTTAAGTAAAAATCAGAGTCTGGTGGGTTATCAGGGAAGAGAAGGT |
| AACTGGGGAACTCAGCGAAGACCGCTGTGGCTTCTCCACACTCTTTATATTGTCCCCGTTTCACAGATGA |
| GGAAACTGACGCTTAGCAAGGCAACTGGCTTCATCGAGCTCATGGAGTTAGCAAGGACACTTTGGGGGT |
| GCTTCAGGCTTGATGGGTGGAGGACCCATTTCTGGGGGTTGCATGAAGATTGGACATTTCCCTAGATGT |
| AGTAGCTTTTCTGGATCCACAGATGACTTGAGATCAGATTTGAATCCTGTTCTGCTCCTCTGCCTCCCAG |
| GCAACCCTCTTGAATAAGAAATGTGGGGGGTACTTTGAATATCTTCATTTTCATTTTGCTTTCATCCAAG |
| TTCTCCTGTGAATTTCAGCTCTGTTTCCATTGCCTTTTTTCACTGGAGATGGGGACATGGGGAGGATGAA |
| TGGACACCCTGGAGGGTCACAGGTCACACCAGGAGGCCATAAGCACTTCTTTTATTTGTGAGTGTATTCC |
| CCCAAGCCTCGTCCTCCTGCTCTGCTATACTCATAATTATATTAATAATTCATATACTAATTCTGTTAAT |
| AATAATTGCTATTATTTTCAACATGGAAATATTTGTCTAAACTTCATAAATGCTCACTATAAGAAACACA |
| GCTCAGGTCACTGCAGAGGTGCAGGTTCAATCCCTGGCCCAGCATAATGGGTTAAAGGATCCAGTGTGGC |
| CACAGCTATGGCTTGAATTCAATCCCTGGCTCGGGAACTTTATGGATGAGCCATAAAAAAGAAAAAAAAA |
| GAGTCATGCAATGCAGATGTGCAGAAAGTAATAAGTTTTCCCATAACCCCAGCTCTTGGAGGGAACCACT |
| GGTATTCATTCCATAATTTAGATCATTTTATGTCCTATGTCTTTAATTTATGTTGCACAGATTTCTGAGT |
| TTGTGCATGTACAGCCTTTTCGTTCCTTTTAAAGGCTGCATAATAGTCCATGGCTGAGCTCTATCAAAGT |
| TGACTTAACCATTAATGAGAACATTTAGGTTGTTTCTAGTTTTTTCCTCTTATTCTAGACAATGCTGCAG |
| AGAAAATCCTTGCGCTTATGTCTTTGGACATGGACCTGAACAGCTTCTTACAAAAATTCATAATAATGGG |
| ATTCTTGACTCTACATTATTGTGTGTATTTTTTAAAAAATGGATGCCAACATTCTCTTGTGGTACGACGG |
| GTTAAGGATCTGGTGTTGTCATTGCAGCAGCTTAGGTTTCTGCTTTGGCTTCGGTTTGATCCCTGGCCTG |
| GGATTTCCACATGTCATGGGTGGGGCCAAAAAATGAATGGAGCCATCAAACTCCCTTCCAGAAAAGGTGC |
| AGCCGATCACCCTTCCATCAGCCTACATGCTGTAATAGTTACTCCTGCGCAGGATTCCCCTTCCCCGT |
| CCCCAACGGTGGCAGCCCCTTCCTCTTAGTAGATGTGGGAAAGTTATGGGTCAGGCTGTTCTCTTCTTAT |
| ACACCCCAATGGTTTCTCTCAATTCTCCCTTTTCTCTTTGAGCCATCCCTCCTCTCAGCTCCTCTGCAAA |
| CTCTCACTCTGGTCCTTCCTCCACCCACCTGGTTTCTTTTGGGGGCTCTTGGCGATGCTTAGAACTACTT |
| TCCTCCATTCCAAGAGAGGTTCTGTTGATTTTCCCAATATCTTATGAGGAAAAAATAGGACTACCTGGTC |
| TGAAAGCTGTCAGTAAGAGAAGGAGCATGAGAGTGTGAGGGACCAGATTTTGAGCACTTTGGAGAATGCT |
| CTACATAGGCGTCATAAACTGAGGCTCAGAAATGTTGTGGTCCAGAGGTCTGTAAGTGATGGAGCTGGGA |
| TGTGAATCTGGAGCTACCTGGTCTTAGATCTCATGCTTGGTTCTCTGTCTCCTTTGCCCTCCTCTTCTTT |
| CTTCTCCTTTTCCTTCCCTCTCTCCTCTTCCACTCTGTCTCCCCAGAACTATGACAGTCATGCTGTTG |
| TCAGACATTTGTGGAGCACTCACTATGTGCCAAGTACAGTTCTAAGCCTTTAATATGTATTGACTAATTT |
| CTTCTCTCAACAACTCTTTGAACCGGGGATTTTTATTATCCCTACTTTACAGATGGGAAAACCAAGGCAC |
| AGAGAAATTAAGTATTATGTCAGTGGAGAAGACAAGCACAGCAGCTCAAAAGAAAATTCCAAGGCACAAG |
| CAGTCAACTCTCCAGATTAGGATAGCCTAGGGTCGTGCGTGACTACCCTAGGTGGTCAGCCACCATTCTC |
| TAGTAATGCTGGGCAAAGACCGAAGCTCCATGTTAAAGGTGGAGACCAGAGGCAAGTCTCAGGGACCTT |
| GCAGCACTTTAGCTTTTGAATTACGGAATTCAAAAACATCTAGAGTAGGCTGCAATAATTCAACTGCCCT |
| ATGTATTTACTGTTTGTTAAAAGGTGTCCTGAGGAGTTTCTGTCTTGGCGCAGCAGAAACGAATACGACT |
| AGGAACCATGAGGTTGGGGGTTTGATTCCTGGCCTCTCTCAGTGGGCTAAGGATCTGGCATGGCTGTGGC |
| TGTAGTGTAGGCTAGCAGCAACAGCTCTGATGAGACCCCTAGCCTGGGAACCTCCATATGCCACGGGTGC |
| GGCCCTGAAAAGACAAAACAAGACCCCTCCCCCCAAAAAAGGTGTCCTGACTGGGGGTGCTCATTTTCT |
| TTTCCACATACGTGTAGAACTACTCTTAAAACTACTTGCCTGATGTATATAAGGCATGAAAAGTGATGAC |
| TGAATACATCTGCCACAGCATATGATGCACTTGATCCCTTTCTTTCTTTCTTTCTTTCTTTCTTTC |
| TTTCTTTCTTTCTTTCTTTTTTGACCATACCCATGGTATGCAGAAGTTCCTGGGCAGGGATTGAA |
| CCTGGGCTACAGCAGTAACCTGAGCCATAGCAGTGACAATGCCAGCCTTAATGGCTAGACCATTGGGG |
| AACTCCGATCCTCTTATTTCTTATTCTGTGATTTTTTTTTTTCTGGTGGATTCTTTGACCCTGTGGTTC |
| AGCCAGTGGGAGGCTCTCTATCAGGCCACTGATCAACGTTACTTTGCATCTTCTCTCTTTCAGTAAAGAA |
| TATCCCGTGGTTCCCAGGAGCACAGTGAGACAGAAAGTGGCCTCCAACCACAGTCCCTTCAGCAGTGAGC |
| CTCGTGCTCTCTCCACCTCATCCAACTTGGGGTCCCAGTATCAGTGTGAGAATGGTGTGTCCGGCCCCTC |
| CCAGGACCTCCTGCCCCCACCTAACCCGTACCCACTTCCCCAGGAGCACAGCCAAATTTACCATTGCACC |
| AAGAGGAAAGGTGAGTGTGACAGCCCTGCCAACTGGCTGCTTTCTCTACTTGAAGAAAAAAAGGACACAT |
| AACCACATGTATTTACTTTAAGAATATAACCAATACAAAACTGCAGAGAGATTGTAAGAAATTCAAACCA |
| TTCGGGTAATACTAGAGATTCCTTTGATATGTCTCCTCCAAGCTCTAGCCCCTTCCTTGGGGACAGACCT |
| TATTGAACTGGTGAGACCCATTTATTTGTTTGTGCTTGCACACACGCATATACAAAGGGTTTTGCTTATA |
| CTTTTAACAGTTGATATCATACTGTATGTATTTTGCAATATGCATTTTTTAAACTTTATAGTACATTGC |
| AGATATCTTTTTGTGAGCCTCCAGTGGCCTCATTCTTTTTAGCTGCTGAAGAGGAAGTATTGTTTCAAAT |
| GGATACAGTGGAGTTTATGGTGCCAGTAATGACCAGGGAGTCTGCGTTGTGTTATAAACCAGTGTTTGG |
| TTGTGTTATAAGCCATGCTGCAGGGAACTGCCTTCGAATTAGATGACTTTTCCTCTTATTATCTGAGTCC |
| AGAGCAGAGGTTAAGGAAGGAAATTTCTCTTGGCATGTTTTTCGAGTCAGAATTGTAAGGGTTGATGTGG |
| GCAGTGGGCCAGAGAAACCCAGATTTGAGTCTCGGCTCTGCCACCAGCTTCCTGTGTGACCTCAGGCAG |
| GTGTCCTAGCCCCTCAGTGCATCAGTTTCTCACTTCGTAAATAGTGCTGAGTTCCTTAGAGCAATTGGTA |
| CTTGGTAAACACCCCGTGGGTGGCAGTTGTGATGAAAAGTGCAGGTATCCTTCCAGAAAGTGAGTCCC |
| GGTAGGAAGTGAGGAGAAGACTGCTCATCCAGGTGAAGGCTGGGAAGCAGGACCTAAGAGGAGGGGACT |
| GTGTACCCTAGGGCTCACTCCCATGGCTTTCAGAGTCAGACAAGTGAGATGAGTCCTAGCTTTGCCATTT |
| TTAAATGTTTATGATGAGGGGCAAGTTAGGAAACTCCTCTAAACCTCACTACAAAACATCTCTAGAGGAG |
| GGAATTCCCATTGTGGCTCAGTGAAAATGAATCTGACTAGTATCCATGTGGATGCAGGTTCAATCCCTGG |
| CCTTTCTCTGTGGGTTAAGGATCCGGCATTGCTGTGAGCTGTGGTAGGTCGCAGATGTGGCTCAGATC |
| CCGAGTTGCTGTGGCTGTGGTGTAGCCTGGCAGCTGCAGCTCCGATTCAACCCTAGCCTGGGAACCGCC |
| ATAGGCCATGGGTGCGACCTAAAAAGACAAAACAAACAAACAAAAAACTTGTATAGAGGAGTTGCCTGC |
| TTCAGTGCAGTGGGTTAATGATCCAGCTTGTCTCTGTGGAGGTGCCAGTTCGATCCCCAGTCTGGTGCAG |
| TAGGTTAAGGATCCAGCATTGCCACAGCTGTAGCGTAGGTTCCAGCTGTGGCTCAGATTCAGTCCCTGGC |
| CCGGGAACTTCCATATGATGTGGGGGTGGCCGAAAAAGAAAAAAACAAACTATAGATTTGGGTTCATGAT |
| TGGACCTGCCTCAAAGGCTTGGTGTGAAGATGTCATGAAGCCGTGCCTGTCCTGTGTTCAGCATAGGGTG |

-continued

| Sequences |
|---|
| AACTTAATAAGCCACCCCTGTTTTGCTCCAGCAGGCCCAAATCTCAGTCTTTTGAGTGGCCTGTTGTACC |
| TCACAGCATTGACAGCCAACACGATGCCTTTCAAAGTCCAGTGCCTGGTCCCTGGACCATCTTGGGGGAA |
| AAAAAAAAAAAAAAACCTTACTAACCAAAACTGATGGCTGGTGCCTGGACCATCTTGAAAAAAATCTGAAC |
| AACTCACTAACCAGAACCAATGGGAAAGGATGCTGTGCTGGCTTTCTCTGGGTGGGGACATAAGGAAAGG |
| AACACACTTTGACTCTAGGACATTTTGAAAAATCATGTTTTGAAGGAGGGAAGAGCTGTCCTTGGTCCAA |
| GCCTGGGGCTGGGGAGCTGACTTGGTGAGACTGAGCTTTCCAGGCTTACCTGAAGCCCATGCAGGCTCCT |
| TGGGTCTGGAGGGACTGAGCACCGTCACCCCAACAAGCCCCCTGGCCCGACTCCCAGCACAACCTCTGCC |
| AGGTGGGCCGGAGACCAGATGCCTGCAAACATGCCTCTCCAGGCACAAGCAGGGGTTAAGAATGCCCCAT |
| GGAGCTCAGGTCCCTGCACAGAGGTTCTGTTTTGTGTTATATTTAAGGGTGTCCTGCCTGGGTTCAGATC |
| ACAACCTTTTCAAGAACGCTATTAAGTAGTTGCTATTATGAACCCACTCGACAAATGGCAAAACTGGGGC |
| TTACAAAGGGAAAATTGTGTCTGATCATTCTTGAAGGCAGAATTTGAATCCAAGCCTGGTCTGCAGACTC |
| TGCTTGGGCCCTGAACCGTTTCTGCTTCTGTTACCTTTGCGTATGAGTGACTGTCTCCAGATTTCATCCT |
| CTACTAGAGATCTACTCTTGAGATTGGGTCAAACATGCCAATTAAGAACTCACCAGGTTTGGAGTTCCTA |
| TAGTGGTGCAGTGGGAAGGAATCTGACTAGGAACCGTGAGGTTGCGGGTTCAATCCTTGGCCTCACTCAG |
| TGGGTTAAGGATCTGGCTTTGCTGTGAGCTGTGGTGTAGGCTGCAGCTGTAGCTCTGATTCGACCCCTAG |
| CCTGGGAACCTCCATATGCCACAGATGCGGCCCTAAAAAGCAAAAAAAACACAACTCACCAGGTTTGAAT |
| TAAAGAGTTCTTTCAATTAAATTAATGTCAGACTAAAAAAAAAAAAAAAAAGAGGAGGAAGTTACAGAGAA |
| TCAGGGCACTGTCTTAGGTTCAGGATTTCCAGCAGCATCATTGTAAGTGCAGCAAAGGATGCAGGGGAAA |
| GACTTCAAAAGCAAGGCTGATGAACCTCTTCAAGTGATGTGAACAGTTGGCTTGTATGGTGCTTCGAGGA |
| ATCCTCGAGTGACCTAGGGATCAACTTGAGGTGGCCCCAGGAGGCTGAATTCAGTGGTTGGTCCATTG |
| CTGTATGTCCCAGCAGTGTGGTCATGGATAACTTGCTTCAACTGTTTTCTGAGCCTCAATCCCCTTTTCT |
| GCAACATGGGGTTAATAGGAGTACCTACCCAGCAGGTTTGTTATGAGATGAAATGAGATGATCCAGGTCA |
| AGCACCCAAAAGTGCCTGGTACCTATAAGTCCCCGTGAGCTAGCCGCTGCCCTGCCCTTGGGAAACTCAC |
| ACTGTCACAAGCAGCTCAGACATTGTGTGACTCATTGTAGTCTTGTTTGATGAAGATGGCAATCAAATGC |
| TATAAAGGAGATATGCAAAGTCCTAACAGAAATCAAAGTGGGGGGTTCCCATTGTGGCTCAGTGGGTTAC |
| AAACACAACTAGGATCCACGAGGATGTGGTTTCAATCCCTGGCCTCATTCATCGGGTTAAAGATCCGGCA |
| TTGAGGCAAGTCTCGGTGTAGTCACAGATTCGGCTTAGATTAGACCCCTAGCCTGGGAACTTCCATATGG |
| TGCAGGTGGGGCCTAAAAAAAAAAGAAAAAAATCAAAATGGGATATTGGACTAGGGTGGGGTGTGGGAA |
| AGGATTTCAGCTGAGGTCTGCAGAGAGTGGAAGTTGGAAAGGAGATGGGGGAGTCCAGTCTGTGTCCAGG |
| TGTGGAAAGAGTATAAGTGCAGTCTTTTGGAAGATGGGGAGCCCGCTTCCACTGGGGGAGTGGACGAAAG |
| CCTGGGGTGGCTGGAACCCAGAGCAGGGGAAAGTGATGAGAGATGAGGCTGCTAGGGTAGGCAAGGACCA |
| GCACAATGCCAGCTCTCGTAAGCCATTAGAGAAGTTCAGATTTTATCCTAACACTGACATGTGGCCATGG |
| AAGGGGTTTGAACCCCTTAGTGGTGAGCAGTGTGATTCTCTCTCCTTTTTTTTTAATGGTTGCACCCTTG |
| GCATATGGAGGTTCCCAAGCCAGGGATCGACCAAGCCACAGCTGCAACCTATGCCACAGCCGCAGCAACT |
| CTATATCCTTAACCCACTGCACCGGGCTGGGGATGGAACCCATGCCTTTGCAGTGACCTGAGCTGCTGCA |
| ATCGGATTATTTTATTTATTTATTTATTTATTGTCTTTTTGTCTTTTTAGGGCTGCACCCGTGTCATATG |
| GAGGTTCCCAGGCTAGAGGTCTAATCTGAGCTACAGCTGTACATCTGCCAGCCTACACCACAGCCACAGC |
| AATGCATGATCCGAGCCGCATCTGCAACCTACACCACAGCTTATGGCAATGCCAGATCCTTAATCCACTG |
| AGCGAGGCCAGGGATCGTACCTGCAACCTAATGGTTCCTAGTCGGATTCTTTTCTGCTGCACCATGATGG |
| GAACTCCTGCAGCTGGATTCTTAATCCACTGCACTATAGCAGGAGCTCATTGGGTTTTTCTTTGGAGCAG |
| TCACTTTGCTGTGATAGAATTGATGCCAGGGCCCTGTTGAGAGCCTGTTGCAGGTCTGAGGTGTGAGAT |
| GATGGTGGCTCAGACCTAGCTGTGGAGGGAAGAGCTGGAGGTGTGGGGGATCTGGACTTCGGGGGTGGCT |
| GCAGGTAACGAGGCGAAGAACTGCCCCTCTCTCATGAATGCAGAAACTGAGGCTCAGAGAGACTGAGAAA |
| CTGGCCTGGAGTCCCTCTCAGCTTAGGGAGCAACTCTGCTCCCAAATCATACTGAGGTCTGTGCTCTTGG |
| GGCGCAGGGCTCTTTTCACCTTTACAGAAACCTCTGCCCTTCTCACCTCCCTCCACCCCCCAAAAGGGAG |
| CTCCCAGGGACAGAGAACATTCCAGCCAAGCTCCGTCTGTCCTGCTTGCCTGCCTCGGAGACGACAAAAA |
| GCAATTCATCATCAGCCTCCATTGTAAAGTGATAAGGAATCAGCCGAGGTTTCCTTCCAGTTTGGGATTC |
| CCGTTAAGTGATAACTCCATGGGTGGCTTCCACCCCTCACCCCTCACCCCCCCGCCCCCCCCCGCCCAC |
| CCCGGCCCTCGCCTCTGCCCCACTATCTGACTTCCCCTCATTGTCTGTCTCCTTTCCAGTGAGCCGGGGG |
| GCAGCCCCAATGAAATGCTCAAAGGGCCAGGCAGGCCAGAGGGCCCCTTGTGTTTGGACCCAGCTGTCTCC |
| AAACTATCTCTCCCGATGGATGGAGCCAAGAAAGCTGGGAAAAGTCTTTTATCAATGCCACTCAATCAAA |
| GCCAGGACCCCAGGGCCTGGGAGAGCACTTGTCTGTCTTTCTGTCCTCCCCCTCCCACCCTGACCACCCT |
| CCCCACCATTGGAAACCAGATGCAACCCAAAGAAAGATTTTAGCTGAGCCACGTACCATACTGGATGCTG |
| AAAGGGAAGCAGGGGTCATTGGGAGGGGGGATTGCAGATAGTAGAGGCTTTTGTATTTTCTTGGTCTCTA |
| CTTTTTAGTAACTCTCCATCCTCTCCATCCTTCACTGGATCCCCACTGTGGTCTTGGAGCCCCAGTAGTT |
| GCTGTACATCCCATTTTGCAGGGGGCAAGTAGAGGACTAAGAGCTTGGTTAGAGTCCCAAGGTTATGTG |
| GCCGGGGAGTGGCAGATGTGGAAGGCATTCATCGCAGAAACAGGGTTAGCTGAGCCACGTACCATACTGGATGCTG |
| ACTCTGCCGCATGCTGAAGGTAAGGGGGGAGCAAGATGGCAGAGGTCTCTGTTCCCAGGACACTTGTATT |
| CTCATAGAGGGGACAGACAGTAAGCAAAGTCAGTCAATTTCATGGCTCAGGGAGTGGCTAGCTGAGGTTT |
| AAGCTGGAGTTTTGATTCACCATCTGGGATCTTCCCATAATACCATAACATCCCAGGTCTTTTTTGTGT |
| GTGCTTTCTAGGGCCATACCTGCGGCATATGGAAGTCCCCAGGCTAGGGGTTGAATCAGAGCTTCAGCTG |
| CCGGCTTACGCCACAGCCACAGCTTTGTGGGATCCGAGCCTAATCTGAGACCTACACTACAGCTCTCAGC |
| AACACCAGATCCCTGACCCACGGAGCGAGGCCAGGGATCGAACCTGCATCTTCATGGATAGTGGTCAGAT |
| TCGTTTTCCCTGGGCCCAAAAGGAAACTCCCTCAGGTCTTTTCACTTTAAGCTAAGAGCATGGGGACACA |
| CACATACAAAAAAAAAAAAGAAAAAGAAACAAAAATCCATCCATCCATCCATAAAGGTCAAGGTTACTACTT |
| TTTCATATTCTTTGAACACAGTGGGTTTCAGGAAAACTGAAAGGCTGAGCCATCTATTCAAAAGAGCACT |
| GCTTTGGGAGTCAGAAGGCCTGAGTTAGAGTCTTACTTCTGACTTGTTGAAGGTCATTCAGCTAAGCAGT |
| GGCAGCTCACCCCTCTGCCTCCAGGGTCTCTGTCTCTAAGCGTCCTTCATCTGAATGAACTCCACCAACA |
| AGAAAAATGACCCATTTGGGAATGGTGACAATATTTGCTCAATGAGATTAGTGTTTTGAAAGCAGCTCTG |
| TGAGTTTTCGAGCTCTGGAATCCACCCAAATACCTTCAAGTATTGGCTGTCCTTCACAGAACCACCTATC |
| CAGTCTTCCAAGAGGGAAACGAGAATCAACCCATATCACTTGGGCAGTAAGATTTGAACACTGACTTTA |
| TGTACAAGAAAGATAGACAGAAAGTAGACTGTCTTTTATTATCTCAATTCCTACATGAAATTTACGTAT |
| TATTCCCATGTATAAACAAGAACTGAGATTGGAGTGTCCAGTGGTTCACCCAAGGTCACGTAGCCCCTGA |
| GTCAGAGACATAACACGGTGCCCTAATATCTGTGTCCTGGATTCATTATTAAAGCCACTTTATCCAGGAT |
| CTACAGCATCTAGAAACATGCAAGGCACCAGGGATTTTCACAGTGCTCTGTGGTGATCGGCGGTCGGAAT |
| CAGGAAGAGCTTTGCAGTTATCCAAGAGACTCAGTGGTGTTCCAGACTTTTGAAGTACAGTTGACCACTC |
| TTACACAACTTTCTGAAACCAAGCTGTGAGCTCGTCTCATGGAGGACTTGACCCTTGACGCCAGCCTGTT |

-continued

Sequences

```
CCTAACCGTGGGAGATAAACAGGACAGAGGTCTTTTGCTGTTGATCAGTTCTCAGGCTCCCAATAAAAG
AAAGAAACCAAACCATCACCAAAATAAACACAGAGATTACATCCCCAAGCATTTATCACGACCAACGTGA
GATGTGGATCCTGGCTTTGGAATTTCTTTACAGTGTCACGAGGACCAAGAGGCACTGGGAAACGCTCAGG
TCCTGTTTGCATCAATAAGCCAGCATCGAGTTTTTCTTAGGACTCTGCATCAGCACTTTGGGGCATTAAA
GACTGGAATGTGTAATTTTATGATTTTCCAAAATGTGCTCTGGCCTTTTTCATATTATTCTTCCTTTTTT
ACTTGTAACAACTCTGGAAGGGGATCAGAAACTTGGGAATGGTTAGTTTGCCTTGTTTTTTTTTTTTTT
TCTTTTGCCAAGGGTACCCTGCAGCTGTACTTTCTATTATTGAAAAGGGGAACGCCCTGGTTAAATGGAA
AACCCAAAGGTTATGATTCCAGCAATAATGGAAACATTCAGATTTATGGATTGGGGGTGGGGGTGGAAGG
AAGAATGGAGGGAAGGAATCAAGAGGAGGTGGCCAGGACAAAAAAAAGTCCAGTGTAGCAATGTCTTTAA
GATGCACTGCTCCCCTAACCCCCCTGAAAAAAACACACCCAGTTGAAAGATGAAAAATGTGGCCACTTGC
TCATCGGGATGTCTTCGAACATCTGCATAGTTGGCATGATGTAGCTAGAATACCTGGAAAAGCGGCTGCA
TTTTTTTTCACTGTTTTGGGGACCAATATTTGGGCGCCCTGTAGGTCCCAGGTGCGTCCCAGAAAGAGTC
TGGCTAAAAATAAGTTTGCTTGCTGTTAGGTGGGTACAACCTTGGTGTAGATGTGTGTTGTTTGGGGATA
TTTTTGACTTACCTGGGGGTATCACTTGGAGAATGCGGCAAGTGGAGGTGTCTGGTGGAAGCCATCCCCA
AGCTACCCTCCTCTCGGTGGGCAGTTGGTTTATAATCCAGCACGAAGCCACAGGACTTACTATGGGGAGA
ATGGCTGGCTTGGAGCTTGAAATCCAAGGCTTACCTGCTGTTCGCAGAGTTCAGCCTCCCACTCTGCTG
CACAGGGAGGGGGTGAAGAGGGGCCAGGAGGTGTGCTGAATGGTCCACAACTACCCGGCATGGTACCTGG
CAATTGAGTAGAGGACTCAGGTAATATCTGTTGGATGATGGGGTGAGTGGTGTTGGATATGAGAGGTTTG
GAGAGCTGGAAGCAAGGTGTGCCCAGCAAAAGTGAATCAGACCTGGTTTGCTTCCAGCTTCCGCTCCTTC
CCAACTGCATGGCCTTGAGCAGGTGACTTCTCTGAGCTTCGGCTTCTGCTGTCAAAAAGGGAGACTGAAA
ACAGCCTCCTTAAGGAATGACTATGAGATGAGAGGCAGATCACTTAGCAGGTGCTCAAGAAATAATAGCT
CTTTTCCCCTCCCTTATTTAGTCCTGTGTTCTGCCTTCATACCATAGACTGTCATTGTGGTCACAATTGT
GGGGATGTTCCTGCTATTTCATTTGTCGTCATGCTCCCCACAGACAGGCATATTCCTTAATGTTACTCAT
TAGGAAGAGAGTGGAAGGGAGGGAAGAAAATCTCCAGTTTGAGGTAAAATTCCAACCAAGGAATGAAC
CTTGAGGTTTACACCTTGGTAGAAACCCCAAGTATTGCTTCCCCTGAAGAAAACACCTGGAGGTGTCTTA
TTACAGATGAGGTCTGTCAGGATGCAGGTGGTGGTGCCCTGGCAACAAGAGCTGCCCGTAGTGATGGATA
CCAGGAGATTTACATGCTCAATTTTATTTCTTAGCTGCCCAGGGTGGTACGTCCTATTAATTCTTATTCA
AAGATGATAAACAGGAGCCCCAGAGACAACAGATGTCCTGCTGGGGTAGCACTGATGTTAAGTAGAGGAG
CCAGATTCAAACTCAAGCATGTCAGGGCTTCTTAACCCCAGGGTCTGGGTTTTAGGAAGCCACCTGCAGT
TGTGTGCATCACTTTGGTCTATACATACAGTTCTTAAAACTTCCTGTTTCAGCGTATTTTTCTAGGAGAG
AGCCCAGCATTTTCATTAGTCCCCAAAGGGGTCAGGGGCCCCAGAGAGGTCAATGGTGACCCTCTTTCAG
AGACAGAACTATCTCCACTGCTCCAAACTAGGGAATAATTAATTAGTGCCTGCAGGGAGTTCCTATTGTG
GCTCAGCGGTAACCAACCCAACTAATATTTATGAGGATGCGGGTTTGATCCCTGGCCTCCCTCAGTGGGT
TGAGGATCCAATGACACTGTAAGCTCTGGTGCAGGTTGCAGCTACAGCTTGGATCTGGTGTTGCTATGGC
TGTGGCTGTGACTGGCAGCTCTGAGTGGACCTCTAGCCTGGGAACTTCCATATGCTGCGGGTGCGGCCCT
ACAAAGCAAAATAAAAAAATAAAAAAATTAGTGCCTGCAGTAGGGAGTGACTTGCTCAGCAAGGAAACA
GCAACATATTAATTCGTACCAACTCAATAGATATTACCTGCATCCTTGTTCACATAAGGCATCAGGAAAG
GATTTGGGGATTTATTCGCGTGCCCATTCACTGATCCATTTGTCCATACATCTGTCCATGCATTGCATGA
GTATTTGTTGCTTGCCTTTCTGTCCAGCATGGCATTGAAGAAAAAGGATTTTTTTTTACCTAGGTGACTA
GGATTTGAATCCTAGCTTCACTGTTTATAAGCCATGTAAGGCTGTTTTGGCAAGTTTCTTAACCTCTCTGT
CTCCTTTCTCTCATCTGTAAAATGAGGATCTAAGGGAACCTGCCTCGTAGCGGGGTTGAGAAGATTAAAT
GGGTGACCTTACAGAGAGTATTCAGAACAGTGCCAGGTGGTGTAAATGCTCTATGTGTTTTTATCATTTT
TGTTGATGCTGTTGTTACTATTTTTGTTATTAGACAGGTCCCAGGTTCTGGGAATATCATGTTGGGTAAT
CCAGACAATGTCCTTCCTTCATGGAATTTACATGCTGGGGAGGAGAGAAGATAATACTAATAATTGCTAT
TTATTGAGCATTTCTTTGTGTCGACCTCTGGACTAGGTGCTTAATCTATATTTTCCCATTTCATTGTCAA
CACTTCCCTTTCTAGAAGGTTCTATTATGCCCCTTTCCATTTTACAGATGAAGAAGCAGAGCTAGTTTCC
CCAGTTTACTAGAAACTATATAAAGCATTTTTTCTAACGACTGTCTTAATGTCCTACTGTGGGAATATAC
TCATTTTTTTTTAAAGAGTTCTCATTGTGGCTCAGCAGGTTAAGGACCCAGCATTGTCTGTGTGAGGATG
TGGGTTCGATCCTGGCCTCTCTCAGTGGTTAAGGATCAGTGTTGCCGCAAGCGGCAATGTAGGTTGCAG
ATGCGGCTCGGATCCAGTGTTGCTGTGGCTGTGGTAGGCTGGCAGGTGCAGCTCTGATTAGCCCTCTA
GCCTGGAAACTTCTCTATGTCACAGGTATGGCCATAAACAGAAAGGAAAGAAGGAAGGAAGGAAAGAGAG
AGAGAAAGAAAGGAAGGAGGAAAGAAGGAAACTGAGCTCAGAAAGGTCAGGCTGTTTGCTTAGAACTCTG
TAGCCCATGGTCTTAGCCATGACAGTCCACCCCCTTTTGCTTCAGAATGGAGGTTGGCGCTGTCTTCCAGG
CATAATTCTTCAGCCCTTAGGCCAAATGTCTGTCTCTGCCTTGAGCTGTGGGGTGGCTGGTCCTGGCCTC
ATAGGTGTCTGTCCTCCTGTCTCAGCAGATGAAGAATGTTCCACCACAGAGCATCCCTATAAGAAGCCCT
ACATGGAGACGTCACCCAGTGAAGAGGACCCCTTCTACCGAGCCGGCTACCCCCAGCAGCAGGGTCTGGG
TGCCTCCTACCGGACAGAGTCAGCCCAGCGGCAGGCCTGCATGTACGCCAGCTCCGCACCGCCCAGTGAG
CCGGTGCCCAGCCTGGAGGACATTAGCTGCAACACGTGGCCCAGCATGCCTTCCTACAGCAGCTGCACAG
TCACCACCGTGCAGCCCATGGACAGGCTACCCTACCAGCACTTCTCTGCTCACTTCACCTCGGGGCCCCT
GGTCCCCCGGCTGGCTGGCATGGCCAACCACGGCTCCCCGCAGTTGGGGGAGGGAATGTTCCAGCACCAG
ACCTCCGTGGCCCACCAGCCTGTGGTCAGGCAGTGTGGGCCTCAGACTGGCCTCCAGTCCCCGGGCAGCC
TTCAAGCGTCCGAGTTCCTGTACTCTCATGGCGTGCCAAGGACCCTGTCCCGCATCAGTACCACTCTGC
TGTGCACGGGGTCGGCATGGTTCCAGAGTGGAGTGACAACAGCTAAAGCGAGGCCTGCTCCTTCACTGAC
GTTTCCAGAGGGAGGGGAGAGGGAGAGAGACAGTCGCAGAGAGAACCCCAAGAACGAGATGTCGCATT
TCACTCCATGTTCACGTCTGCACTTGAGAAGCCCACCCTGGACACTGATGTAATCAGTAGCTTGAAACCA
CAATTCAAAAAATGTGACTTTGTTTTGTCTCAAAACTTAAAAAATCGACAAGAGGCGATGAGTCCCACC
CCCCCTACCCCGCCCCCACCATCCACCACCACCACAGTCATCAACTGGCCACATTCACACGACCTCCAGA
TGCCCTCCGGGATTCCTTCTTTTGGTCTCCAGAAAGTCTTGCCTCATGGAGTGTTTTATCCCAAAACATA
GATGGAGTCATTCCCTGTCTTGGTGTTACTGTTGACATTGTTATATAATAAATAATAATATATTTTTTC
TTTCAATTTCTTAATGGGACCCAGTCCCTTATTTTGGGGGAGGTCTGAGGCAAATATGTTTCAACATAC
TTGCTTGCGGGGTTCCCCCAACACCCATACTCCACCCCCCCAAATCTAAATTCACCGAGCCTCCCCCTT
AACTAAGAAATTACCTACCTCTGCCACGTGATGTTTCTGCAAAGCTTCCTGGTGTCCCAGCTTCTGTCCG
CTTTGGTCCTACCTGCCCCCTCCTCAAGGAGTCTAGTTCTGCCTTCTCCCCACCAGTGGAGTCAGGATAA
GGCTGGAATCCATCAGGCGTCCCATCTTACCCAGCCGTCCAGCCGTCCCAGCTCGGTGTCTTTCCAGCCT
GCTAAAATGTGGCCTATAGCTTCCCTACCGGAAAGAGTGCTTTGAAAAACTTAAAAAGCCCCGGTTTACA
TTCGGGCAGAACTGTGATAAGCAAGGCGAAAGCTCTGTGCTGACAAGCGTTGTGAAAAAGCCAAAGTAAA
TACTCGTCCCCATTTAAAAAAAAAAAAAAAAAAAAAACAACCGAAAAAAACAAAGCCAGCCCCCAGCTTC
```

| Sequences |
|---|
| CAAACCTCCATCGCTGACGACCTGACCTGGATGCCTAGATGCAAAGCCACATCCACAACCCCCAAAGAAG<br>AGGCAAGACTGTACTCACTGATCAGCTCTCCCCAAAGGCATCACACCAGCACCAAATGCAGACACAAAC<br>TGTGGTTATTGAAAGCAGAAAACGGTGTTTAAAAAAAAAGTGTGTAAGTAAAACATTATTGCAGGGTTCT<br>TCAGATGTAATATTTTCCTGGTACTATTTATTTATAAATAGGAGTTCTAATTAAGTAATAACGTGAAATG<br>AAATCCAGCATGGGAGCTGGCCAAGAGCTTTTAATTTTATTGATACTCAAAACCAAGTTTGCGTTTTTTG<br>TTTTTTTGTTTTTTCCTTTCAGATGTGCTTTGCTTTCTTGATTAAAAAAAGTTGTTGTTTTTTTTAACTG<br>ACCCTAATAAAGAGAACAGGGTAATATGTGAGACTGCGTATGTTCACGACGTGAGAGTGTGTATGTTTG<br>TAATGTGAGCGTCTATGCGATTATGTCGTTATATGTTGCGAAGGGGGGGGGTAAGAATTAAGTAGTCGTT<br>CAGTATATTTGTGTGCCAATTAATGCCTAATAAATACTGCGTGCTTAAAAA (SEQ ID NO: 47) |

Human HAND2 (Gene ID: 9464)
Location: chromosome 4 Exon count: 2
Range: 5001..8727 (3727 bp)
>NG_046954.1:5001-8727 *Homo sapiens* heart and neural crest derivatives
expressed 2 (HAND2), RefSeqGene on chromosome 4

| |
|---|
| CTGTACATGGAGATCTTGCTGGGAAAATCCGCTTGCTCCCCTCACGTCGTCCAGCCCAGGAGAACCACCG<br>CCGTCACCCCGGAGCTTCCTCGGCCACCGCGCAGAGCCCTCCGAGAGCCCGAGCCGCGGTCTTCGAGCTC<br>CAAGGCTCATTCAGGGCCCCAGATCCTTGCCCCGAAAGGAGAGGATCTGAGAAAATGGATGCACTGAGAC<br>CTCTCTGAAAACCCTCCGAGAGAGCGCGAGAGGAGCGAGGACACGTTACTCGCAGCTAAAATCACATTTA<br>AGGACCAAAACAACAACAACCAAAAATTTCATTAAAACAATAAGCGCCCAAGAACCCAGATCGGGCTGGT<br>GGGGGGAGGGGAAGAGGCGGGAAGGGGAGGGTCGCACGGAGGTAGCTTTGCAGTGAGCAGTCGACCCCGC<br>CGCCCCCGGCACAGCTGGACCGGCTCCTCCAGCCGCGGCTCAGACTCGCCCCTGGATTCCGGGTTAGCT<br>TCGGTGCCAGGACCGCGGCCCGGGCTTGGATTCCCGAGACTCCGCGTACCAGCCTCGCGGGAGCCCCGGC<br>ACCTTTGTATGAGCACGAGAGGATTCTGCCTCCGCGCAAGCAGCCCGGGAAGCAGGAGCCGAAGCGCGGGC<br>CGTGGAGCAAGGCGGGAACCGGAGGCGGCGGCGGCGGCGGCCAGGGGCGCACGGTGCCAGGACCAGCTCG<br>CCGCGCCCCATGGGGAGCCGGCGGCCGCAGCGCTGCTGAGGCGGGCCCGGCTGGCCAGGCGGGGGGACGG<br>GGCCCGGGCTGCAGCAGCCCCCTCTGCGGCTGCCGGGCGGGCCCGGGCGCCCGGGGCTGGGGGGTGGGG<br>GGTGGGGGAGGACGCCGAGCGCTGAGGCAGGGGCCCGGGCCGAGGGCGCGGCGGGGCTGCGCGCACGCTG<br>GGGCGCGTGGAGGGGCGCGGAGGGCGAAATGAGTCTGGTAGGTGGTTTTCCCCACCACCCGGTGGTGCAC<br>CACGAGGGCTACCCGTTTGCCGCCGCCGCCGCCGCAGCTGCCGCCGCCGCCGCCAGCCGCTGCAGCCATG<br>AGGAGAACCCCTACTTCCATGGCTGGCTCATCGGCCACCCCGAGATGTCGCCCCCCGACTACAGCATGGC<br>CCTGTCCTACAGCCCCGAGTATGCCAGCGGCGCCGCCGGCCTGGACCACTCCCATTACGGGGGGGTGCCG<br>CCGGGCGCCGGGCCCCCGGGCCTGGGGGGCCGCGCCCGGTGAAGCGCCGAGGCACCGCCAACCGCAAGG<br>AGCGGCGCAGGACTCAGAGCATCAACAGCGCCTTCGCCGAACTGCGCGAGTGCATCCCCAACGTACCCGC<br>CGACACCAAACTCTCCAAAATCAAGACCCTGCGCCTGGCCACCAGCTACATCGCCTACCTCATGGACCTG<br>CTGGCCAAGGACGACCAGAATGGCGAGGCGGAGGCCTTCAAGGCAGGATCAAGAAGACCGACGTGAAAG<br>AGGAGAAGAGGAAGAAGGAGCTGGTCAGTACCAGGGGGCGGCAGGCGGTGGGGCTGAGGGGGTCAGGGAA<br>CTGGTGCTCCCGGCCTCTTTCCAATTGGGCTGAGAAATGGCATCTCGTGTTCTTTGGCTGCGTCCCGCTT<br>CAAGGTTGTTTGCACCAGGTTGTGTAAGGATGGCTTCCGGCATAAGCAGAGAGTTGAGGGGAGGGTGTCA<br>GCAGGAGGAGGAGAAGGTTAGGGATGCTTTGCGCTGGTGATCTTACCTCCGGATTGCTGCTCCCCTA<br>GTACTTAGGACGGACCTTGAAAACTCTGGGTCGCGATCGATCGCGATCGCACTGGTCTGGATGCCTCACC<br>CCGTCTCTGTTAGACCCTTCTTTTGGCCTCCAATCCAATCTTGCTTTCAGATGTTTCCAGAATAAGTCTC<br>GAAGAAGCCCTTGATTCCAATTATTTCACTATTGATCGCACCCCCTACCCCACTCCCAGAAGGAGGCTGC<br>CAGAGACTGAGCCCTGAGTTTTGTGGTTGTTCTCATACTATGCCCGGAAAACGTAATGGTAAACATAAAA<br>TAAGTACTTTTGACTTCAAAATACAGCTCCAATTTTTCCTTGGCTATGACGTTAAAATGTAATTTCCCAG<br>ATGAGTATATTCCATTGGCATTTCTAATTTTATTTGAATAAGCCTGTACATTTTAAGGGGGAAAAGGCAT<br>TACTATGGTCATTGTTATTAAAAATAACACGAAAGTAAATTGAGCGCTTAAAATTTTCTCAGATTCCTA<br>CCAAGTGCCCACAGGGCAGTGGTGCAGGATAGAGCTATGTCCACGAAGGGCCCGAAAATAATTGCATTT<br>GTCGAATTTTCTTCTTTGGCCCCTGCAGCCCTTTGGTGGCTGCATAATCGAGTGACCTCCCGAATAACC<br>AGAGATTTCAGAAGCCTTGGAGGAGAGGCACTGCTGAGCTGGAGGCCGAGAGCCTCTGGCCGAGAGGCCC<br>AGGCCGAAACAGAGGCTCCTTCGCCCTATTTTTCCTAGATGTGGATCTAGGATTGCTAATGAAAACAGAG<br>AAACCAGACTTAGCGCCGACTCCAGCTCCCGCCCCTACATCTGGAGTAAGAGAAAAGGCCCCCCGCTCCT<br>CCATAAACGACTCGAAAACGGGCGGTTGTTTATAAACTTGTGGATCCGGTTGTTGAGCGCTGCAGCGCCG<br>AGGCCTCCCCGCCGGCTAGGGTAGCGCTAACCTTGGTAGCTTCTCTGCAGGGGCTGGGACTCCCCCATCG<br>TATCCTTTCCTCTCTGGTTCACTGTCTCCTCCGGCGCAGGAAGCTCCGGGTTGGTGTGGAACCAGGTATC<br>CTCTCTGAATTTCTCTTTCCACTTTTCTCGCCCTCGCCTTTCCTCTGTCCAGAACGAAATCTTGAAAAGC<br>ACAGTGAGCAGCAACGACAAGAAAACCAAAGGCCGGACGGGCTGGCCGCAGCACGTCTGGGCCCTGGAGC<br>TCAAGCAGTGAGGAGGAGGAGAAGGAGGAGGAGGAGAGCGCGAGTGAGCAGGGGCCAAGGCGCCAGATGC<br>AGACCCAGGACTCCGGAAAAGCCGTCCGCGCTCCGCTCTGAGGACTCCTTGCATTTGGAATCATCCGGTT<br>TATTTATGTGCAATTTCCTTCCCCTCTCTTTGACCCCCTTTGAGGGCATCTGCTCCCCGTCTCCCCCTCCA<br>AAAAAAAGTGGATATTTGAAGAAAAGCATTCCATATTTTAATACGAAGAGGACATCCCGTGTGGTAAG<br>GGATCCCGTCGTCTCATAGATTCTGTGTGCGTGAATGTTCCCTCTTGGCTGTGTAGACACCAGCGTTGCC<br>CCCCGCCAACCTACTCAACCCCTTCCAGATAAAGACAGTGGGCACTAGTGCGTTTGTGAAGTGTATCTTT<br>AATACTTGGCCTTTGGATATAAATATTCCTGGGTATTATAAAGTTTTATTTCAAAGCAGAAAACAGGGCC<br>GCTAACATTTCCGTTGGGGTCGGTATCTAGTGCTATCCATTCATCTGTGGTCGTTCCCTCTTTGAAGATG<br>TTTCCAACAGCCACTTGTTTTGTGCACTTCCGTCCTCTAAAACTAAATGGAATTTAATTAATATTGAAGG<br>TGTAAACGTTGTAAGTATTCAATAAACCACTGTGTTTTTTTTTACAAAAACCTTAATCTTTTAATGGCT<br>GATACCTCAAAAGAGTTTTGAAAACAAAGCTGTTATACTTGTTTTCGTAATATTTAAAATATTCAGAAGT<br>AAACTAAATTATCATGA (SEQ ID NO: 48) |

Pig HAND2 (Gene ID: 100153751)
Location: chromosome 14 Exon count: 12
Range: 16460089..16462979 (2891 bp)
>NC_010456.5:16460089-16462979 *Sus scrofa* isolate TJ Tabasco breed Duroc
chromosome 14, Sscrofa11.1, whole genome shotgun sequence

| |
|---|
| GGGAGGACGCCGAGCGCCGAAGCAGGGGCCCGGGCTGGGGGCGCGGCGGGGCTGCGCGCACGCTGGGGCG<br>CGGAGGGCGAAATGAGTCTGGTTGGGGGCTTCCCTCACCACCCGGTGGTGCACCATGAGGGCTATCCGTT |

-continued

Sequences

CGCCGCGGCCGCGGCCGCTGCGGCCGCCGCGGCCGCCAGCCGCTGCAGCCACGAGGAGAACCCCTACTTC
CACGGCTGGCTCATCGGCCACCCCGAGATGTCGCCCCCCGACTACAGCATGGCCCTGTCCTACAGTCCGG
AGTACGCCAGCGGTGCCGCCAGCCTGGACCACTCCCATTACGGGGGGTGCCGCCGGGCGCCGGGCCCCC
GGGCCTGGGGGGCCGCGCCCGGTGAAGCGCCGGGGCACAGCCAACCGCAAGGAGCGGCGCAGGACTCAG
AGCATCAACAGCGCCTTCGCCGAGCTGCGCGAGTGTATCCCCAATGTGCCCGCCGACACCAAACTCTCCA
AGATCAAGACGCTGCGCCTGGCCACCAGCTACATCGCCTACCTCATGGACCTGCTGGCCAAGGACGACCA
GAACGGCGAGGCGGAGGCCTTTAAGGCGGAAATCAAGAAGACAGATGTGAAAGAAGAGAAAAGGAAGAAG
GAGCTGGTTAGTACCAGGGGACGGCGGGCGGTGGGGTGTGGGGGACCGAGAATCCCGGTCTCTTTCCCTT
TGGCCTGAGCAATGGCACACCGCGCTCTCTGCTGCATCCTGAGACAAGGTTGTTTGCACCAGGTTGTGGT
CGAGATGGTTTCCCGAAGAAGCAGAGGAGGTGGGGAGGGTGTCAGCACGCGGAGGAGGTTAAGAGGGAT
GCTTCGTGTGGGTGATCTTCCCTCCGGGTCATTGCTGCTCTCCCCCCCCCAACACCCCCCCCGCACCC
CGCTCCCCCGGGCCCTTGAGGCAGGACTCAGGTTCCGAATTGATCTTCTGATCGCACTGGCCGGACCCC
TCATTTTCTGTCCTTTAGAGCCTTCATTTGGCGTCCAATCCGATCTTACTTTCAGATAGTTATAAAATAA
GTTGTTTAGAAGCGCTTGATTCCAATGATTTCACTGTTGATCGCATTGTCCCCTTTTAAGATCGAGGCTG
CCACTGATTCTAAGAGAGTTTTGTGGTTGTTCTGATTAGTATGCCCAGTTACGTAAAGGTTAACATAAAA
TATGTACTTTTAACTTCAAAATGCATCTCGTTTCTCTCTGGCAGTGAAGATAAAATGTAACTTCCCAGGC
GACTGTACTTAAATGGGCATTTCTTGTTTTGTTTGCATGAGCCCATTTAAGACAAATGGTAAATATTACC
ACTGTCATTTTATCGTTAACAAAAATGAAAAATTATAACTGAAAATTAGTTTTCTCAAGTACCTACCAGG
TGCCCATAGGGTAGTGGTGTTTAGAGCAGGGCTATTCCCATGAAAGGCCTGCAAAATAATCCCATTTGTC
AAGTTTTCCTTCTTGGGGCCTGTGGCGTTTTAGTTGCTGCATAGTCGAGTGATTCCGGGGTAACCAGGGAT
TTTGGAGGCCTTGGAGGAGAGCCGAGCCGGAGGCCGAGCCACCGGCAGACAGGCCCAGGCGGAGGCACTT
GGCCCATCTTCCCTAGAGCGCAGATCTGGGACTGCGATTGAAACAGGGAAACCAGATTTAGCGCCAACCC
CCCCGCTCGCAGCCCTACATCTGGAGTTAAAGAGAAGGCCCCCAGTTCCTCCATAAACGACTTGAAAACG
GGTGGTTGTTTATAAACTTGCCGATCCGGGAGTTGAGCCTGCAGCATGTCTGGAGCCCTGGAGCTCAAGCAGTG
AGGTGGAGAAGGAGGAGGAGGAGGAGGAGGAGAGGAGGAGGAGAGCGCGAGCCAGGCCCTGGAGCCGGA
TGCAGACCCAGGACTCCGGGGCGAGCTCTGCGCACTCCGCTCTGAGGACTTCCTGCATTTGGATCATCCG
GTTTATTTATGTGCAATGTGCCTCCCTCTCTTTGCCCCCCTTTGAGGCATCCGCTCCCCACCACCCCCTC
CAAAAAAGTGGATATTTGAAGAAAAGCATTCCATATTTTAATATGAAAACCTTCCCGCGTGGTAAGG
GATCCCGTCGTCGTCTTGTAGATTCTCTGTTTGTGAATGTTTCCTCTTGGCTGTGTAGACACCAGCGTTG
CTCCCTCCCCACCTATCCAGCCCCTTACAGATAAAGACAGCTGATAATAGTGTATTTGTGAAGTGTATCT
TTAATACCTGGCCTTTGGATATAAATATTCCTGGGGATTATAAAGTTTTATTTCAAAGCAGAAAACGGGG
CCGCTAAGATTTCCGTTGGGGTCGGTATCTAGTGCTGCCGTTTCATCTGTGTGGTTCCCTATTTGAAGAT
GTTTCCAACAGCTCCTTGTTTTGTGCACTTCCGTCCTCTAAAACTAAGTGGAATTTAATTAATATTGAAG
GTGTAAACGTTGTAAGTAATCAATAAACCACTGTGTGTTTTTTTTTTTACAAAACCCCAATCTTTTAA
TGGTTGATACCTCAAAAGAGTTCTGAAAACAAAACTGTTATACTTGTTTTCATTATATTTAAAATATTCA
GAAGTAAACTAAATTATCATG (SEQ ID NO: 49)

Human MYOD (Gene ID: 4654)
Location: chromosome 11 Exon count: 3
Range: 17719563..17722131 (2569 bp)
>NC_000011.10:17719563-17722131 Homo sapiens chromosome 11, GRCh38.p12
Primary Assembly
GAGAAGCTAGGGGTGAGGAAGCCCTGGGGCGCTGCCGCCGCTTTCCTTAACCACAAATCAGGCCGGACAG
GAGAGGGAGGGGTGGGGGACAGTGGGTGGGCATTCAGACTGCCAGCACTTTGCTATCTACAGCCGGGGCT
CCCGAGCGGCAGAAAGTTCCGGCCACTCTCTGCCGCTTGGGTTGGGCGAAGCCAGGACCCGTGCCGCGCCA
CCGCCAGGATATGGAGCTACTGTCGCCACCGCTCCGCGACGTAGACCTGACGGCCCCCGACGGCTCTCTC
TGCTCCTTTGCCACAACGGACGACTTCTATGACGACCCGTGTTTCGACTCCCCGGACCTGCGCTTCTTCG
AAGACCTGGACCCGCGCCTGATGCACGTGGGCGCGCTCCTGAAACCCGAAGAGCACTCGCACTTCCCCGC
GGCGGTGCACCCGGCCCGGGCGCACGTGAGGACGAGCATGTGCGCGCCCAGCGGGCACCACCAGGCG
GGCCGCTGCCTACTGTGGGCCTGCAAGGCGTGCAAGCGCAAGACCACCAACGCCGACCGCCGCAAGGCCG
CCACCATGCGCGAGCGGCGCCGCCTGAGCAAAGTAAATGAGGCCTTTGAGACACTCAAGCGCTGCACGTC
GAGCAATCCAAACCAGCGGTTGCCCAAGGTGGAGATCCTGCGCAACGCCATCCGCTATATCGAGGGCCTG
CAGGCTCTGCTGCGCGACCAGGACGCCGCGCCCCTGGCGCCGCAGCGCCTTCTATGCGCCGCAGCAACGC
TGCCCCGGGCCGCGGCGGCGAGCACTACAGCGGCGACTCCGACGCGTCCAGCCCGCGCTCCAACTGCTC
CGACGGCATGGTAAGGCCGGGACCCCAGGAAGTGAGGAAGTTAGGGCGGCGCTCGGGATATCAGGGACGC
GTTTCCGAGGGCGGGGAGCTGGCCTTGCGGGAGGTTTGGGCCAGGATCCTTCCCGAGAGAGGGACCCCC
TTGTCCTGGGCAGCTGTCACTGGGGTAGCCTGTTTTGGAAGTGTGCAGGCAGCGTTCGAGCTGCCCCAT
TGGGGGCGCTATTAGAACACTGCAGCGCGAACGTGAAGATCTTTTTCTCTACTTATCCCTACTTCCAAAA
TGTAAATTTGCGCCCCTTGGTGACTGTCCGCCCTTGGTTTGGCCCTGCATGTTGCAGACCTCATCTCCTA
CCCACCCGTAATTACCCCCCCAACCAGGACAGGTCTGGGCCCGGAACTAGAGCCTTAGGCTAGAGTTAGG
GAGGGGGCGGCTACAGGAATTGGTGTTCGGGCCTCGAGCCGTCCCGCGGGCCTGACTCAGTCGCCCTTGC
TGTTTGCAGATGGACTACAGCGGCCCCCGAGCGGCGCCCGGCGGAACTGCTACGAAGGCGCCTACT
ACAACGAGGCGCCCAGCGGTGGGTATTCCGGGCCTCTCCCTGCTCGCTCCTCCTCCTTCATGGAGCTGTC
CTGGCCTCTATCTAGGACGCTCCCACCCCCACTCACACACGCCTATGTCCTGGGAAGTGGTGCAGGAGAT
GAAATACTAAGCAAGTAGCTCCCTGTCTTTGGATTGTCCCGGACTCTAACTAAAGTCCTCAGTTTCCAA
TCTGTCTCAAAGTACTGGGCCCGGGGGTGGGAGGCTTGTCGCGGCCCACCCCTGCTTACTAACCGAGCC
CTCCCCGCGCAGAACCCAGGCCCGGGAAGAGTGCGGCGGTGTCGAGCCTAGACTGCCTGTCCAGCATCGT
GGAGCGCATCTCCACCGAGAGCCCTGCGGCGCCCGCCTCCTGCTGGCGGACGTGCCTTCTGAGTCGCCT
CCGCGCAGGCAAGAGGCTGCCGCCCCAGCGAGGGAGAGCAGCGGCGACCCCACCCAGTCACCGGACG
CCGCCCCGCAGTGCCCTGCGGGTGCGAACCCCAACCCGATATACCAGGTGCTCTGAGGGGATGGTGCCCG
CCCACCCGCCCGAGGGATGGTGCCCCTAGGGTCCCTCGCGCCCAAAAGATTGAACTTAAATGCCCCCCTC
CCAACAGCGCTTTAAAAGCGACCTCTCTTGAGGTAGGAGAGGCGGGAGAACTGAAGTTTCCGCCCCCGCC
CCACAGGGCAAGGACACAGCGCGGTTTTTTCCACGCAGCACCCCTTCTCGGAGACCCATTGCGATGGCCGC

| Sequences |
|---|
| TCCGTGTTCCTCGGTGGGCCAGAGCTGAACCTTGAGGGGCTAGGTTCAGCTTTCTCGCGCCCTCCCCCAT<br>GGGGGTGAGACCCTCGCAGACCTAAGCCCTGCCCCGGGATGCACCGGTTATTTGGGGGGCGTGAGACCC<br>AGTGCACTCCGGTCCCAAATGTAGCAGGTGTAACCGTAACCCACCCCCAACCCGTTTCCCGGTTCAGGAC<br>CACTTTTTGTAATACTTTTGTAATCTATTCCTGTAAATAAGAGTTGCTTTGCCAGAGCAGGAGCCCCTGG<br>GGCTGTATTTATCTCTGAGGCATGGTGTGTGGTGCTACAGGGAATTTGTACGTTTATACCGCAGGCGGGC<br>GAGCCGCGGGCGCTCGCTCAGGTGATCAAAATAAAGGCGCTAATTTATA (SEQ ID NO: 50) |

Pig MYOD (Gene ID: 407604)
Location: chromosome 2 Exon count: 2
Range: 41422522..41424236 complement (1715 bp)
>NC_010444.4:c41424236-41422522 Sus scrofa isolate TJ Tabasco breed Duroc
chromosome 2, Sscrofa11.1, whole genome shotgun sequence

| ATGGAGCTGCTGTCGCCACCGCTCCGCGACGTAGATTTGACGGGCCCCGACGGCTCTCTCTGCAACTTTG<br>CAACAGCGGACGACTTCTATGATGACCCGTGTTTCGACTCCCCGGACCTGCGCTTCTTCGAGGACCTGGA<br>CCCGCGCCTCGTGCACGTGGGCGCGCTCCTAAAGCCCGAGGAACACTCGCACTTCCCTGCCGCAGCGCAC<br>CCGGCCCCGGGAGCTCGTGAGGACGAGCATGTGCGCGCCCGCCCAGCGGGCACCACCAGGCGGGCCGCTGTC<br>TACTGTGGGCCTGCAAGGCGTGCAAACGCAAGACCACTAACGCCGACCGCCGCAAGGCCGCCACCATGCG<br>CGAGCGGCGCCGCTTGAGCAAAGTCAACGAGGCCTTCGAGACTCTCAAGCGCTGCACGTCTAGCAACCCG<br>AATCAGCGGCTGCCCAAGGTGGAAATCCTGCGCAACGCCATCCGCTATATCGAAGGCCTGCAGGCGCTGC<br>TTCGCGACCAGGACGCCGCGCCCCTGGCGCTGCAGCGGCCTTTTACGCGCTGCCCCGCTGCCCCCGGG<br>CCGAGGCGGAGAGCACTACAGCGGTGACTCAGACGCATCCAGCCCGCGCTCCAACTGTTCCGACGGCATG<br>GTAAGGCCAGGACTCTGGGCCAGAGAAGTGAGGGCAGTTCTCGGTATATCGCCAGTGTGTTTCCGAGGGA<br>GGGCAAGGAGTTGGCCCCCAGCTGGGAGGGTTGGGTGGGGAACGTTTCCGAGAGTGAACCCCCTGTGCCC<br>CGGGCAGTTGTCACTGGGTTGGCCTAGTGCTTTGGGGACGCACGGACGGATGCGATCCATCCGATTGAG<br>GGCATTATCAGAACACTGCAGCGCCAACACGAAGATCTGCTTTTTCACCATTTCTCCCTATTGTCAAAAT<br>GCAGATTTGTGCTACGTGACTGTCTACCCTCTATTTGGCTCGGCAAGCTCCAGAGAGCTCCTGCCTACTC<br>TTCCTTCCCAACCCGGACAGATCTGGGCCCGGAACTCTTGTGGCTGACACTTGGGGAGTTGGGGAAGGGG<br>CGGCCACAGGGAGTGATGCTCCAGCCCTGCGCGGTTCCCAAGACTAACCTGGTCGCCCTTGCTGTTTGCA<br>GATGGATTATAGCGGCCCCCGAGCGGTGCCCGGCGGCGGAACTGCTACGACGGCACCTATTACAGCGAG<br>GCGCCCAGCGGTGCGTATTCTCAACCCCTTCCCACATTCCCTTTTGAGCTGCCCTGGCTTCTCTTATCTA<br>GGACCTCCTCGTCCCCATCCTGGGAGATGATACAGGGAATGAAACACTAAGCCTGTAGTTCCTTTTCTCC<br>GTGAAATTTTGCGGCATCCTCGCGAATTCTGGCTGGCCCCCAGTTTCCCGTCTGCCCCAAAGCACTGAGA<br>CCAGAGGTGGGAGCCTAGTCCGCCACTCCACCCTTGCATACTAACCTACCCCTTCCCCGCGCAGAACCCC<br>GGCCCGGGAAGAATGCTGCGGTGTCGAGCCTCGACTGTCTGTCCAGCATCGTGGAGCGCATCTCCACCGA<br>GAGCCCCGCCGCGCCCGCGCTTCTGCTGGCGGACACGCCGCGGGAGTCGTCTCCGGGCCCGCAAGAGGCG<br>GCCGCCGGGAGCGAGGTCGAGCGCGGCACCCCCACCCCTTCCCCGGACGCCGCCCCGCAGTGCCCCGCGA<br>GCGCGAACCCCAACCCTATCTACCAGGTGCTCTGA (SEQ ID NO: 51) |

Human MYF5 (Gene ID: 4617)
Location: chromosome 12 Exon count: 3
Range: 80716929..80719668 (2740 bp)
>NC_000012.12:80716929-80719668 Homo sapiens chromosome 12, GRCh38.p12
Primary Assembly

| TCTGCCCTTGTTAATTACCGGAGCGACAGACTAGGGAGCTCCGCCCGGGATTTGCCCATCGGCGGAGGCG<br>CCAGGCTCCCGTTTCTCCCCATCCCTCTCGCTGCCGTCCAGGTGCACCGCCTGCCTCTCAGACAGGATGGA<br>CGTGATGGATGGCTGCCAGTTCTCACCTTCTGAGTACTTCTACGACGGCTCCTGCATACCGTCCCCCGAG<br>GGTGAATTTGGGGACGAGTTTGTGCCGCGAGTGGCTGCCTTCGGAGCGCACAAAGCAGAGCTGCAGGGCT<br>CAGATGAGGACGAGCACGTGCGAGCGCCTACCGGCCACCACCAGGCTGGTCACTGCCTCATGTGGGCCTG<br>CAAAGCCTGCAAGAGGAAGTCCACCACCATGGATCGGCGGAAGGCAGCCACTATGCGCGAGCGGAGGCGC<br>CTGAAGAAGGTCAACCAGGCTTTCGAAACCCTCAAGAGGTGTACCACGACCAACCCCAACCAGAGGCTGC<br>CCAAGGTGGAGATCCTCAGGAATGCCATCCGCTACATCGAGAGCCTGCAGGAGTTGCTGAGAGAGCAGGT<br>GGAGAACTACTATAGCCTGCCGGGACAGAGCTGCTCGGAGCCCACCAGCCCCACCTCCAACTGCTCTGAT<br>GGCATGGTAAGCAATAGATCTGGTACCTGCTAGGCTACCCTAATCTTTTCTAAAGTCCTTACACCTCATT<br>TAACCTGGTGTGGTGGGGAGAGTGGGGTGGAGGCAGATGCTGAGTTGCTTTAAAAGAAGAGAGGGTCCA<br>CATTTAGAAAGACTCCCCAAACCGCTGCTGAACAAGATTTTAGTTTAACTTTCTAGCAGGTTCTAGGTGT<br>ACACTGTAATCGAGTGTTGACATGGAAGATGGGTGGCTGTGAATGATCACTCAGATGTTTTCTCCATTCC<br>TGAATTTATTTTCAAAATATGCCATCTGTGGATCATGCCCTACGCTAATATCTAAAGGCACCGTTTCTAA<br>CTTAATGAGGAAATGGAAAGAAATACCCACACGGCCCCAGTTCCTGCTCCAATGAGGCCTGGCTGAAAGA<br>TGTTGATGCATTCTTTTTAGAGGGCGTTTGCTCCAAGGCTGCCAGGTTTTAATGTGTTTTTGCCCTGGGA<br>AAGTGTTCTTTCCCTGAATTAGTGTGGCTTTCTTCTACTCCAATCCATTTTGCATGGTTAACCCAATGCA<br>CATTGCTGCTGAATTCCACCCCCTCTTCCCTTTGCTGCTGCTCTCCTCTTCTTCAAGCACAGAGATTGAC<br>CTCAGTGCCCTGGGAATTTGGAGAGGGCTAGCCCTTCCTAAATCAAGGCAGTGAAGGTGATTGACAGTGT<br>TCGGTTACAGAGCTGGTGGGCAAGCACAGCCTCACCTTTGGTCAGAACATCTTTTGCCAAGACCTGAAAA<br>CAAACTTTGTTGTGTGTCTTGTATTATAGCCCGAATGTAACAGTCCTGTCTGGTCCAGAAAGAGCAGTAC<br>TTTTGACAGCATCTACTGTCCTGATGTATCAAATGGTAAGAATTGATAACTTCACAGGAGTTTAAAGACC<br>AGTTCAACCTAACAATTCAGCCTATAAGATTCTGTTCTTGCTGATAGTATTGGGGAAGGGAGAATGGAAG<br>TGATGGTTCTTATAGGGAGGCTTTGGTAAAGCAAAATAAACACATCTTCTGCTCCAAATCCCCCTAGCAG<br>ACACGCACGCACACATGCATACACACATGCACACACAATGTTGCTTGAAATATTATCAGGGGGCTTCCCC<br>ACTCCCCACGTCTACCCCTCAGGAATTGCCAGATATTTGTTGCAAATTTCTATGTTAGGCTTTCTGTGAC<br>CACCTGACCTCTGGGTGTCAGAGGAGCTGACCTACAATTTAAGGAGCAACATAAGCAAATCTGTCTATCT<br>TGGGCTAATTATTTTTTAATGCTTTTCTCCTTGTATCCTTAGTATATTGCACAGATAAAAATCCTTATC<br>CAGCTTGGATTGCTTATCCAACATAGTGGACCGGATCACCTCCTCAGAGCAACCTGGGTTGCCTCTCAG<br>GATCTGGCTTCTCTCTCCAGTTGCCAGCACCGATTCACAGCCTGCAACTCCAGGGGCTTCTAGTTCCA<br>GGCTTATCTATCATGTGCTATGAACTAATTTTCTGGTCTATATGACTCTTCCAGGAGGGCCTAATACAC<br>AGGAAGAAGAAGGCTTCAAAAAGTCCCAAACCAAGACAACATGTACATAAAGATTTCTTTTCAGTTGTAA<br>ATTTGTAAAGATTACCTTGCCACTTTATAAGAAAGTGTATTTAACTAAAAAGTCATCATTGCAAATAATA<br>CTTTCTTCTTCTTTATTATTCTTTGCTTAGATATTAATACATAGTTCCAGTAATACTATTTCTGATAGGG |

| Sequences |
|---|
| GGCCATTGATTGAGGGTAGCTTGTTGCAATGCTTAACTTATATATACATATATATATATTATAAATATTG<br>CTCATCAAAATGTCTCTGGTGTTTAGAGCTTTATTTTTTTCTTTAAAACATTAAAACAGCTGAGAATCAG<br>TTAAATGGAATTTTAAATATATTTAACTATTTCTTTTCTCTTTAATCCTTTAGTTATATTGTATTAAATA<br>AAAATATAATACTGCCTAATGTATATATTTTGATCTTTTCTTGTAAGAAATGTATCTTTTAAATGTAAGC<br>ACAAAATAGTACTTTGTGGATCATTTCAAGATATAAGAAATTTTGGAAATTCCACCATAAATAAAATTTT<br>TTACTACAAG (SEQ ID NO: 52)<br><br>Pig MYF5 (Gene ID: 100153269)<br>Location: chromosome 5 Exon count: 3<br>Range: 100753440..100755558 complement (2119 bp)<br>>NC_010447.5:c100755558-100753440 *Sus scrofa* isolate TJ Tabasco breed Duroc<br>chromosome 5, Sscrofa11.1, whole genome shotgun sequence<br>GGCTTCTCCCCGATCTGATCTATCTCGCAGCTGCCCAGGTGCACCGCCCGCCTGTCCGCAGAAGATGGAC<br>CTGATGGACGGCTGCCAGTTCTCGCCTTCTGAGTACTTCTACGATGGCTCCTGCATCCCATCCCCCGAGG<br>GCGAGTTCGGGGACGAGTTTGAGCCACGAGTGGCTGCTTTCGGGCGCACAAAGCAGACCTGCCCGGCTCA<br>GACGAGGAAGAGCACGTGCGAGCACCTACGGGCCACCACCAGGCCGGCCACTGCCTCATGTGGGCTGCA<br>AAGCGTGCAAGAGGAAATCCACCACCATGGATCGGCGGAAGGCGGCCACCATGCGCGAGCGGAGCGCCT<br>GAAGAAGGTCAACCAGGCGTTTGAGACGCTCAAGAGGTGCACCACGACTAACCCCAACCAGAGGCTGCCC<br>AAGGTGGAGATCCTCAGGAATGCCATCCGCTACATTGAGAGCCTGCAGGAGCTGCTGAGGGAGCAGGTGG<br>AAAACTACTACAGCCTGCCCAGGCAGAGCTGCTCTGAGCCCACCAGCCCCACCTCCAGCTGCTCCGACGG<br>CATGGTAAGAGAAAGCTCGGGACCTCCTAGGCCCTTCTAATCTTTCCAAAAAACTTTACCTCTCGTTTAA<br>GCCAGGTGTAGCAACCGAATATTCTGATAGTTGGCTGTGGGGGTGAGGAGGCAGTTGCCCTAAGAGAGAT<br>GCCCCATTTAGACAGACGCCAGGAAACCGCTGCTGAAGAGCATAATACTTTGCCTCCCAAGTTCTAGGTG<br>AACGTTGCCGGGGGAGGTTCTCATGTGAGACGGGTGGCTGTGAATGATCAGAGGTTTTCTCCATTACTCA<br>CTTTACTTCCGATATATACCCCCCGTGGACCCCACCGTACACTAACGTTTAAAGGCAACTGACGGAGGCT<br>CCCCATAGCGCATGGTTTCTAACTCTAGGCAGAAATGGGATGAAACACCCGCATGGCCCCGGTTGCTGCT<br>CTGCTGAGGCCTGGCTGGAAGATGTTGATGCATTCTTTTCAGAGGGTGTCTGCTCTAACGCTGCCAGGTT<br>TTAATGTGTTTTTGCCTGGGAAAGTGTTCTCTCTCCGAATTAGTGTGGCTTCCTTCCACCCCAATCCAT<br>TTTGCATGGTTAACCCAGTGCACGTTGCTGCCGAATTCCACCCCGCCCCTCTCCTTTTCTCCCAGTACAG<br>TGACTGACCTCAGCGCCCTTGCCATTTGGGGAGGCGAGCCCTTCCTAAATCAAGGCAGTGAAGGTGACTG<br>AGAGTGGTCAACTTTCGAAGCTGGAGGGCAAGCACTGCCTCACCCTCCATCAGAGCACCTTTCGCCAAGA<br>CCTGAAAACAAATGCCTTCTTTTGTGTCTTTTATTATAGCCTGAATGCAACAGCCCTGTCTGGTCCAGAA<br>AGAGCAGCAGTTTTGACAGTATCTACTGTCCGATGTACCAAATGGTAAGAACGAACGCCTTTAGAGGAGG<br>TTAAAGACCAGTTCAACTTCACAGTTCAGCCCATCAAATCAGTCTGTCCTTCCAGGCAGTTATCTGGAGG<br>AAAAGAGAATGGTTTTTACAGGGACTTTTTGGCGGAGCAAAATAAACATCTGCTCAAAATTCCCCTCAGA<br>GATACTCCCATGCACACACACAGGCACATGAGCTTTTGCTTAAAACATTACCGAGGGTGCTTCTCCACTC<br>CCCACCTGCACCCCCATGAATTGCTAGATATATATGTTGCAAATTTCTACACTGGGGTCTCTGTGACCAC<br>CTGACCTCTGGGTTTCAAAGGAGCTGACCTGCAGTTCAAAGGGCAACGTAAGCAAGTCTACCTATTGGGT<br>TTTTTTTTTTTTTTTTAACGTTTTTTTTTTCCCCTTGTATCTTTAGTATATGCCACGGATAAAAGCTCC<br>TTATCCAGCCTGGATTGCTTATCCAGCATAGTGGATCGGATCAGCAACTCCGAGCAACCTGGACTGCCTC<br>TCCAGGACCCAGCCTCTCTCTCCAGTTGCCAGCACCGATTCTCAGCCTGCAACTCCAGGGGCCTCTAG<br>TTCCAGGCTCATCTACCATGTGCTATGAACTAAAAATCTAGTCTAGACCATTTCTGCCAGGAGTGCCTAT<br>TACACAGGAGGAAGGAGGC (SEQ ID NO: 55)<br><br>Human MYF6 (Gene ID: 4618)<br>Location: chromosome 12 Exon count: 3<br>Range: 80707629..80709478 (1850 bp)<br>>NC_000012.12:80707629-80709478 *Homo sapiens* chromosome 12, GRCh38.p12<br>Primary Assembly<br>ACTGCACTAATTAAATGCCATCTGGGTGGTTCCTCTGGGTTTTTGAGTCCATCACCCAGTTCAGATCGAG<br>TCAGAGGCCAAGGAGGAGAACATGATGATGGACCTTTTTGAAACTGGCTCCTATTTCTTCTACTTGGATG<br>GGGAAAATGTTACTCTGCAGCCATTAGAAGTGGCAGAAGGCTCTCCTTTGTATCCAGGGAGTGATGGTAC<br>CTTGTCCCCCTGCCAGGACCAAATGCCCCCGGAAGCGGGGAGCGACAGCAGCGGAGAGGAACATGTCCTG<br>GCGCCCCCGGGCCTGCAGCCTCCACACTGCCCCGGCCAGTGTCTGATCTGGGCTTGCAAGACCTGCAAGA<br>GAAAATCTGCCCCCACTGACCGGCGAAAAGCCGCCACCCTGCGCGAAAGGAGGAGGCTAAAGAAAATCAA<br>CGAGGCCTTCGAGGCACTGAAGCGGCGAACTGTGGCCAACCCCAACCAGAGGCTGCCCAAGGTGGAGATT<br>CTGCGGAGCGCCATCAGCTATATTGAGCGGCTGCAGGACCTGCTGCACCGGCTGGATCAGCAGGAGAAGA<br>TGCAGGAGCTGGGGGTGGACCCCTTCAGCTACAGACCCAAACAAGAAAATGTAAGCCTAGATGCTGCCGG<br>GGCAGGGAAATGCGAAGGCTGATTAAACGCCTTCCGCGGGGCCTTAACCTCCAGCTGCTTGGTCTTTTTT<br>CCCTTCCCCCTTTCTCGCCCGCCCCTCCCGCTCCGTCTCTAATGAACCCCCAGTGACCCAAGAAGACCGG<br>GTGCTTGCAATAGGCAGGAAATGCGTACCCGGCCCGAGGAAGCAGGAAAGCCGCCCCCCACCCCACCCCA<br>ACCCCGGAACCGATGTTTCTTTCCTAATCTGCCGCTGCCTTGGTTTTCCCTCCAGCTTGAGGGTGCGGAT<br>TTCCTGCGCACCTGCAGCTCCCAGTGGCCAAGTGTTTCCGATCATTCCAGGGGGCTCGTGATAACGGCTA<br>AGGAAGGTAAAGTAAAAGGGCTCTGGGCCGCACCAGAGAAAATCCGGGAGGTGGATAGGATGCTTGGGCC<br>GAGAGGGCTCGAAGCGAGAGCAGGGACGCGCCCTGCGAAAAGGGCGCTCTTTGCGCGCCGGGACCAGGCC<br>TTTCCTCGCTGCCAAAGCGGCCTCGCGCGGGGCGCGGAGCTGCTTCGTGTTCCTTCTTTGGGTGCTATGT<br>TTGTGTGTTGTTTTTCGCTCAGGAGGAGCAAGTATTGATTCGTCAGCCTCGAGTAGCCTTCGATGCCTT<br>TCTTCCATCGTGGACAGTATTTCCTCGGAGGAACGCAAACTCCCCTGCGTGAGGAAGTGGTGGAGAAGT<br>AACTGAGCCTGCGCTTGAGACCTTCTCCACGCAGCAGGAAGATCCCACCGACCCTTCCTGGCCTAATCCT<br>TTAGATTAGGTCACATTACATTAACATTTAGGAACCCAGACCGAAAAGTTGCTGAAAGGGAAGGAGACAC<br>ATTCACAAAGAAACGTTGCGAAAATTGCGAAATCTGTTGTGCAATGCTCAAATGAAAACGCCTTTCGGCTT<br>TGGGCTTTTATTTTTTTGGAACTGCGAGTGGCTTAGGTCTAGCCTCATTTTGTTTTTGTTTGGTTGGTTT<br>TATACTATATTAACTTTTATTACGGTGATCCTTTTGTGCCATGTTCAAAAGAAGTTCATTCCTGTCTAAA<br>GTGGGAAAGTTGCATTTAATGTTAGGGGTATTTAATGTATTTTTGTAAATAGTTTAACACTTTCTTTTTT<br>TACGTAAACCTGAAATATATTTTAAATGTGGAATGATGTATATAAAATGTGCGAGGATCCTGGTATTGTA<br>ATATTAAAAAGAAGTTTCTATATGAACAAA (SEQ ID NO: 53) |

-continued

Sequences

```
Pig MYF6 (Gene ID: 397005)
Location: chromosome 5 Exon count: 3
Range: 100762918..100764771 complement (1854 bp)
>NC_010447.5:c100764771-100762918 Sus scrofa isolate TJ Tabasco breed Duroc
chromosome 5, Sscrofa11.1, whole genome shotgun sequence
ACTAATTAAATGCCATCTGGGTGGCTCCTCTGGGTTTTTGAGCCCATCACCCAGTTCAGACCGAGTCAGA
GGCCAAGGAGGAGAACATGATGATGGACCTTTTTGAAACTGGCTCCTATTTCTTCTATTTGGACGGGGAA
AATGTTACCCTGCAGCCCCTAGAAGTGGCAGAAGGCTCTCCTTTGTATCCAGGGAGTGATGGTACCCTGT
CCCCCTGCCAGGACCAAATGCCCCCGGAAGCTGGGAGCGACAGCAGTGGAGAGGAACATGTCCTGGCGCC
CCCAGGCCTGCAGCCTCCCCACTGCCCCGGCCAATGTCTGATCTGGGCTTGCAAGACCTGCAAGAGAAAA
TCTGCCCCAACCGACCGCAGGAAGGCCGCCACTCTGCGCGAGAGGAGGAGGCTGAAGAAAATCAACGAGG
CCTTCGAGGCACTGAAGCGGCGGACTGTGGCCAACCCCAACCAAAGGCTGCCCAAGGTGGAGATCCTGCG
GAGCGCCATCAACTACATCGAGAGGTTGCAGGACCTGCTGCACCGGCTGGATCAGCAGGACAAAATGCAG
GAGCTAGGCGTGGACCCCTTCAGCTACAGACCCAAGCAAGAGAATGTAAGCCCAGACGCCGCCGGGGCAG
GGGAATGCAAAAGCTGATTAGAAGCCTTCCTTGGGGCCTTTACTTCCAGCTGCTCCTCTTGGTTCCCGTC
CCCCTTCCTCGACCCCACCCTCTCCCACCCCGCTCCCCCTCTAATGAACCCCCACTGACCCGTGAACACG
GGGTGCCTGCAACAGGCAGGAAATCTGTACTTGGCCTGAGGAACCAGGGGAGACACCCCCCAGCCCCGG
AACGTTGCTTTTGCCTAATCTGCTGCCTCTCTCTTCCTCCAGCTTGAGGGTGCGGATTTCCTGCGCACCT
GCAGCTCCCAGTGGCCAAGTGTTTCGGATCATTCCAGGGGGCTCGTGATGACTGCCAAGGAAGGTAAAGC
AAAAGGGCACTGGGCCCCGCGGGAGACCATCCCGGGAGGGGGCTGGGTGCTCGCTGGGGGCAGAACGCCC
CGGGCGCCTGCGGGAGCCGGTCCCGCCCCGCGCGAGCCGAGAGCGGAGGCGCCCTCGAGCCGGGCGCTCC
CGCCGCGCGCACCGGCGCCCGCGCCCAGCGGCACCGCGGGCGGCTCCCTTCCGTGGGGTTACGTTTGTGT
GCGTGTGTGTGTGTTTTCTGCGCCCAGGAGGGACAAACATTGATTCGTCAGCCTCGAGGAGCCTTCGG
TGCCTTTCTTCCATCGTGGACAGCATTTCCTCGGAGGAACACACGCTCCCCTGCGTCGAGGAAGTGGGGG
AGAAATAACTCGCGGCCGGAGACGGTCTCCACGCAGCAGCAAAAGCCCACCCTCCTCCTCCTCCTCCTCC
GCCTAATCCTGTAGATGAGGTCACGTTACGTGAATATTTAGGAACCCTGACTCAGGAGCTCACGAAAGGG
AAGGGGACATCTTCGCAAAGAAACTTCTCGGAAGCTGTTGCGCACGCTCGGAGGAGAAGCCTCGCAGCCT
TGGGCTTTTCTTCGGCGAACTGCGAGTGGCTTAGATCTACAGCAGCCTTGGTTTTTGCTGGGTGGGCTCT
GTAACATATTTACGTTTCCTATGGTGATCCTTTTGTGCCCTGTGCAAAAGAAGTTCATTCCTGTCTAAAG
CAAAGTGGGAACGTCGCAACTGTTAGTGGGATTGAATGTATTTTTGTAAATAATCTTAGTACTTTCATTT
TTTTATGTCAACCTAAGAAATATATTTTAAACGTGGAGTGAGGTATTGTATACATAGCGTGCAAGGATCC
TGGTATTGTTATATTAAAAAGATAAGTTTCTATA (SEQ ID NO: 54)
```

Example V—BLC2 Overexpression with Aggregation

Figure 18:
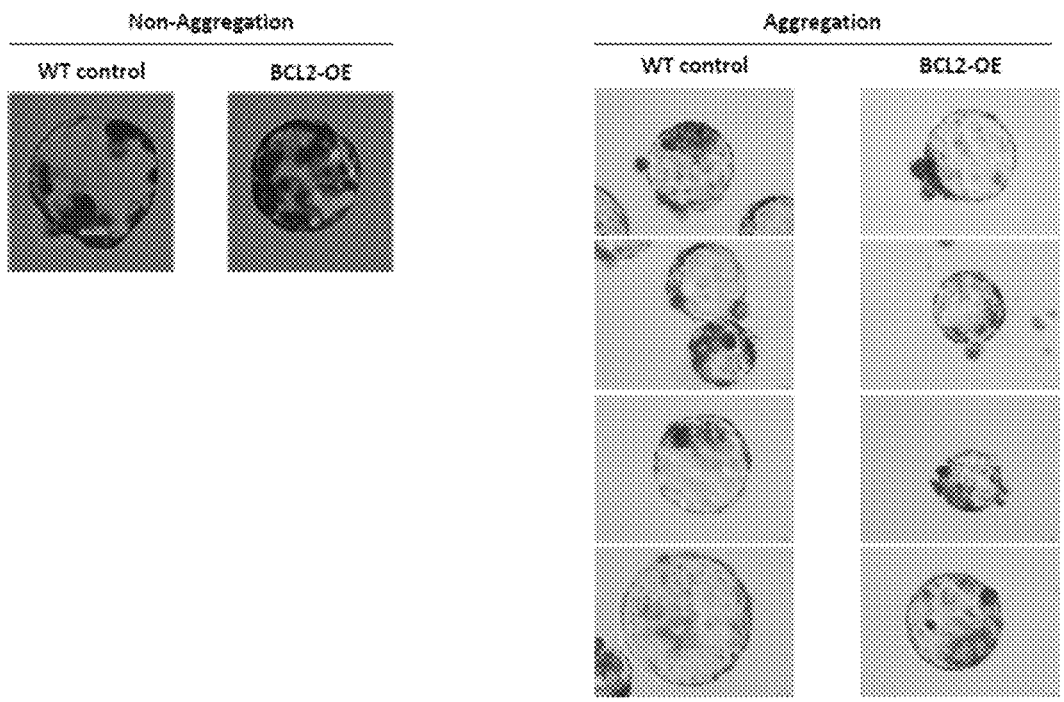
FIG. 18 demonstrates that aggregation and BCL-2 overexpression synergistically increase human-pig chimera formation.
Figure 19:
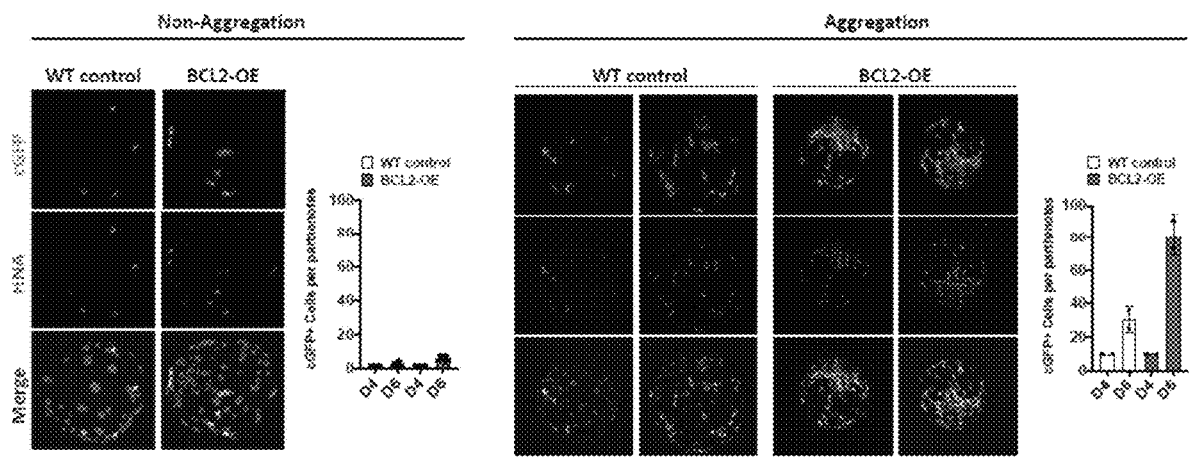
FIG. 19 demonstrates that aggregation and BCL-2 overexpression synergistically increase human-pig chimera formation.

Combing BCL-2 overexpression (discussed herein above) and aggregation (discussed herein above), it was demonstrated that this combination surprisingly provided synergistic and significantly enhanced interspecies chimerism, including human:pig chimera formation (FIGS. 18 and 19). Such unexpected results for combinations such as TP53+aggregation; BLC-2+TP53+aggregation, as well as BLC-2+TP53.

BIBLIOGRAPHY

1. T. Kobayashi et al., Generation of rat pancreas in mouse by interspecific blastocyst injection of pluripotent stem cells. Cell 142, 787-799 (2010).
2. J. Usui et al., Generation of kidney from pluripotent stem cells via blastocyst complementation. Am J Pathol 180, 2417-2426 (2012).
3. A. Ferdous et al., Nkx2-5 transactivates the Ets-related protein 71 gene and specifies an endothelial/endocardial fate in the developing embryo. Proc Natl Acad Sci USA 106, 814-819 (2009).
4. T. L. Rasmussen et al., ER71 directs mesodermal fate decisions during embryogenesis. Development 138, 4801-4812 (2011).
5. N. Koyano-Nakagawa et al., Etv2 is expressed in the yolk sac hematopoietic and endothelial progenitors and regulates Lmo2 gene expression. Stem Cells 30, 1611-1623 (2012).
6. T. L. Rasmussen et al., VEGF/Flk1 signaling cascade transactivates Etv2 gene expression. PLoS One 7, e50103 (2012).
7. T. L. Rasmussen et al., Etv2 rescues Flk1 mutant embryoid bodies. Genesis 51, 471-480 (2013).
8. A. K. Hadjantonakis, S. Macmaster, A. Nagy, Embryonic stem cells and mice expressing 581 different GFP variants for multiple non-invasive reporter usage within a single animal. BMC biotechnology 2, 11 (2002).
9. X. Shi et al., The transcription factor Mesp1 interacts with cAMP-responsive element binding protein 1 (Creb1) and coactivates Ets variant 2 (Etv2) gene expression. J Biol Chem 290, 9614-9625 (2015).
10. K. M. Whitworth et al., Use of the CRISPR/Cas9 system to produce genetically engineered pigs from in vitro-derived oocytes and embryos. Biology of reproduction 91, 78 (2014).
11. A. M. Giraldo, S. Ball, K. R. Bondioli, Production of transgenic and knockout pigs by somatic cell nuclear transfer. Methods Mol Biol 885, 105-123 (2012).
12. T. Yamaguchi et al., Interspecies organogenesis generates autologous functional islets. Nature 542, 191-196 (2017).
13. J. Wu et al., Generation of human organs in pigs via interspecies blastocyst complementation. Reproduction in domestic animals=Zuchthygiene 51 Suppl 2, 18-24 (2016).
14. M. Iacovino et al., A conserved role for Hox paralog group 4 in regulation of hematopoietic progenitors. Stem Cells Dev 18, 783-792 (2009).
15. G. Chen et al., Chemically defined conditions for human iPSC derivation and culture. Nat Methods 8, 424-429 (2011).
16. N. Koyano-Nakagawa et al., Feedback Mechanisms Regulate Ets Variant 2 (Etv2) Gene Expression and Hematoendothelial Lineages. J Biol Chem 290, 28107-28119 (2015).

17. L. Lai, R. S. Prather, Production of cloned pigs by using somatic cells as donors. Cloning Stem Cells 5, 233-241 (2003).
18. S. Sembon et al., A simple method for producing tetraploid porcine parthenogenetic embryos. Theriogenology 76, 598-606 (2011).
19. Z. Machaty, W. H. Wang, B. N. Day, R. S. Prather, Complete activation of porcine oocytes induced by the sulfhydryl reagent, thimerosal. Biology of reproduction 57, 1123-1127 (1997).
20. K. M. Whitworth, J. Zhao, L. D. Spate, R. Li, R. S. Prather, Scriptaid corrects gene expression of a few aberrantly reprogrammed transcripts in nuclear transfer pig blastocyst stage embryos. Cellular reprogramming 13, 191-204 (2011).
21. J. Zhao et al., Significant improvement in cloning efficiency of an inbred miniature pig by histone deacetylase inhibitor treatment after somatic cell nuclear transfer. Biology of reproduction 81, 525-530 (2009).
22. B. K. Redel et al., Glycine supplementation in vitro enhances porcine preimplantation embryo cell number and decreases apoptosis but does not lead to live births. Mol Reprod Dev 83, 246-258 (2016).
23. J. Allard et al., Immunohistochemical toolkit for tracking and quantifying xenotransplanted human stem cells. Regen Med 9, 437-452 (2014).
24. C. Suzuki, K. Yoshioka, Effects of amino acid supplements and replacement of polyvinyl alcohol with bovine serum albumin in porcine zygote medium. Reprod Fertil Dev 18, 789-795 (2006).
25. T. Mito et al., Birth of piglets from in vitro-produced porcine blastocysts vitrified and warmed in a chemically defined medium. Theriogenology 84, 1314-1320 (2015).
26. L. D. Spate, A. Brown, B. K. Redel, K. M. Whitworth, R. S. Prather, PS48 can replace bovine serum albumin in pig embryo culture medium and improve in vitro embryo development by phosphorylating AKT. Mol Reprod Dev 82, 315-320 (2015).
27. R. M. Petters, M. L. Reed, Addition of taurine of hypotaurine to culture medium improves development of one- and two-cell pig embryos in vitro. Theriogenology 35, 253 (1991).
28. Q. H. Nguyen et al., Single cell RNA-seq of human induced pluripotent stem cells reveals cellular heterogeneity and cell state transitions between subpopulations. Genome Research 28(7), 1053-1066 (2018).
29. C. Trapnell et al., Differential gene and transcript expression analysis of RNA-seq experiments with TopHat and Cufflinks. Nature Protocols 7(3), 562-578 (2012).
30. S. Anders, P. T. Pyl, W. Huber, HTSeq-aPython framework to work with high-throughput sequencing data. Bioinformatics 31(2), 166-169 (2015).
31. A. Butler, P. Hoffman, P. Smibert, E. Papalexi, R. Satija, Integrating single cell transcriptomic data across different conditions, technologies and species. Nature Biotechnology 46(5), 411-420 (2018).

The invention is described with reference to various specific and preferred embodiments and techniques. However, it should be understood that many variations and modifications may be made while remaining within its scope. All referenced publications, patents and patent documents are intended to be incorporated by reference, as though individually incorporated by reference.

SEQUENCE LISTING (55 sequences)

SEQ ID NO: 1 - DNA, 20 bp, Artificial Sequence
  A synthetic oligonucleotide
gtcaccaatcctgtccctag

SEQ ID NO: 2 - DNA, 20 bp, Artificial Sequence
  A synthetic oligonucleotide
cagcagacgtcacaatccgc

SEQ ID NO: 3 - DNA, 20 bp, Artificial Sequence
  A synthetic oligonucleotide
tggtaccgactagatcctcc

SEQ ID NO: 4 - DNA, 20 bp, Artificial Sequence
  A synthetic oligonucleotide
gaagggcatgatggattctg

SEQ ID NO: 5 - DNA, 20 bp, Artificial Sequence
  A synthetic oligonucleotide
ggtagctttggggtgtcttg

SEQ ID NO: 6 - DNA, 20 bp, Artificial Sequence
  A synthetic oligonucleotide
ggacttgtggaactgggatg

SEQ ID NO: 7 - DNA, 20 bp, Artificial Sequence
  A synthetic oligonucleotide
ccctgggacagataaggatg

SEQ ID NO: 8 - DNA, 19 bp, Artificial Sequence
  A synthetic oligonucleotide
acgcccatctgttgtcaag

SEQ ID NO: 9 - DNA, 20 bp, Artificial Sequence
  A synthetic oligonucleotide
gtcctctcaaagggggacac

SEQ ID NO: 10 - DNA, 20 bp, Artificial Sequence
  A synthetic oligonucleotide
acagtctgcaccaccattca

SEQ ID NO: 11 - DNA, 20 bp, Artificial Sequence
  A synthetic oligonucleotide
tgtctgttgtgcccagtcat

SEQ ID NO: 12 - DNA, 20 bp, Artificial Sequence
  A synthetic oligonucleotide
ctggaaaagccctccaagat

SEQ ID NO: 13 - DNA, 20 bp, Artificial Sequence
  A synthetic oligonucleotide
agcaaaagacccgactcaga

SEQ ID NO: 14 - DNA, 20 bp, Artificial Sequence
  A synthetic oligonucleotide
ctgccgtctctctcctgagt

SEQ ID NO: 15 - DNA, 20 bp, Artificial Sequence
  A synthetic oligonucleotide
agacttcctctgccctctcc

SEQ ID NO: 16 - DNA, 18 bp, Artificial Sequence
  A synthetic oligonucleotide
ggcctcttcatcgggaat

SEQ ID NO: 17 - DNA, 20 bp, Artificial Sequence
  A synthetic oligonucleotide
cccacagttggaggagaatc

SEQ ID NO: 18 - DNA, 18 bp, Artificial Sequence
  A synthetic oligonucleotide
agttccaactgtgcgacc

SEQ ID NO: 19 - DNA, 20 bp, Artificial Sequence
  A synthetic oligonucleotide
tcttcaaccagcccctctta

SEQ ID NO: 20 - DNA, 19 bp, Artificial Sequence
  A synthetic oligonucleotide
acgccccattcacattctg

SEQ ID NO: 21 - DNA, 20 bp, Artificial Sequence
  A synthetic oligonucleotide
tgacagtgactcggaggaga

SEQ ID NO: 22 - DNA, 20 bp, Artificial Sequence
  A synthetic oligonucleotide
ccctcgagccgataagaaag

SEQ ID NO: 23 - DNA, 20 bp, Artificial Sequence
  A synthetic oligonucleotide
aggcggaaatcaagaagaca

SEQ ID NO: 24 - DNA, 23 bp, Artificial Sequence
  A synthetic oligonucleotide
taatgaccagtcaacgggcgata

SEQ ID NO: 25 - DNA, 19 bp, Artificial Sequence
  A synthetic oligonucleotide
tgcggcatccacgaaacta

SEQ ID NO: 26 - DNA, 22 bp, Artificial Sequence
  A synthetic oligonucleotide
cgaggcgggtggatcatgaggt

SEQ ID NO: 27 - DNA, 17 bp, Artificial Sequence
  A synthetic oligonucleotide
ggctcactccttggcgc

SEQ ID NO: 28 - DNA, 22 bp, Artificial Sequence
  A synthetic oligonucleotide
cagcttctcataattcatgccg

SEQ ID NO: 29 - DNA, 20 bp, Artificial Sequence
  A synthetic oligonucleotide
cattcgatacaaacccacca

SEQ ID NO: 30 - DNA, 19 bp, Artificial Sequence
  A synthetic oligonucleotide
ccttccctatgttcgccac

SEQ ID NO: 31 - DNA, 18 bp, Artificial Sequence
  A synthetic oligonucleotide
acctgtgcctgcgaaaag

SEQ ID NO: 32 - DNA, 20 bp, Artificial Sequence
  A synthetic oligonucleotide
tcttgtcgttgctgctcact

SEQ ID NO: 33 - DNA, 24 bp, Artificial Sequence
  A synthetic oligonucleotide
ggattatgctgcttgaccaaggaa

SEQ ID NO: 34 - DNA, 20 bp, Artificial Sequence
  A synthetic oligonucleotide
gccgtgatctccttctgcat

SEQ ID NO: 35 - DNA, 20 bp, Artificial Sequence
  A synthetic oligonucleotide
tctgtcgcccaggccggact

SEQ ID NO: 36 - DNA, 21 bp, Artificial Sequence
  A synthetic oligonucleotide
cctcgccgatgtgttaggaag

SEQ ID NO: 37 - DNA, 20 bp, Artificial Sequence
  A synthetic oligonucleotide
cctgagcagcaatcatcact

SEQ ID NO: 38 - DNA, 19149 bp, Homo sapiens
gatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattgggtaagctcctgactgaacttgatgagtcctctctgagtcacgggctctcggctccgtgtattttcagctcgggaaaatcgctggggctgggggtggggcagtggggacttagcgagtttgggggtgagtgggatggaagcttggctagagggatcatcataggagttgcattgttgggagacctgggtgtagatgatggggatgttaggaccatccgaactcaaagttgaacgcctaggcagaggagtggagctttggggaaccttgagccggcctaaagcgtacttctttgcacatccacccggtgctgggcgtagggaatccctgaaataaaagatgcacaaagcattgaggtctgagacttttggatctcgaaacattgagaactcatagctgtatattttagagcccatggcatcctagtgaaaactggggctccattccgaaatgatcatttgggggtgatccggggagcccaagctgctaaggtcccacaacttccggacctttgtccttcctggagcgatctttccaggcagcccccggctccgctagatggagaaaatccaattgaaggctgtcagtcgtggaagtgagaagtgctaaaccaggggtttgcccgccaggccgaggaggaccgtcgcaatctgagaggcccggcagccctgttattgtttggctccacatttacatttctgcctcttgcagcagcatttccggtttctttttgccggagcagctcactattcacccgatgagaggggaggagagagagagaaaatgtcctttaggccggttcctcttacttggcagagggaggctgctattctccgcctgcatttctttttctggattacttagttatggcctttgcaaaggcaggggtatttgttttgatgcaaacctcaatccctccccttctttgaatggtgtgccccaccccgcgggtcgcctgcaacctaggcggacgctaccatggcgtgagacagggagggaaagaagtgtgcagaaggcaagcccggaggtattttcaagaatgagtatatctcatcttcccggaggaaaaaaaaaaagaatgggtacgtctgagaatcaaattttgaaagagtgcaatgatgggtcgtttgataatttgtcggaaaaacaatctacctgttatctagctttgggctaggccattccagttccagacgcaggctgaacgtcgtgaagcggaaggggcgggcccgcaggcgtccgtgtggtcctccgtgcagccctccggcccgagccggttcttcctggtaggaggcggaactcgaattcatttctcccgctgccccatctcttagctcgcggttgtttcattccgcagtttcttcccatgcacctgccgcgtaccggccactttgtgccgtacttacgtcatctttttcctaaatcgaggtggcatttacacacagcgccagtgcacacagcaagtgcacaggaagatgagttttggcccctaaccgctccgtgatgcctaccaagtcacagacccttttcatcgtcccagaaacgtttcatcacgtctcttcccagtcgattcccgaccccacctttattttgatctccataaccattttgcctgttggagaacttcatatagaatggaatcaggctgggcgctgtggctcacgcctgcactttgggaggccgaggcgggcggattacttgaggataggagttccagaccagcgtggccaacgtggtgaatccccgtctctactaaaaaatacaaaaattagctgggcgtggtgggtgcctgtaatcccagctattcgggagggtgaggcaggagaatcgcttgaacccgggaggcagaggttgcagtgagccaagatcgtgccactacactccagcctgggcgacaagaacgaaactccgtctcaaaaaaaaggggggaatcatacattatgtgctcatttttgtcgggcttctgtccttcaatgtactgtctgacattcgttcatgttgtatatatcagtattttgctccttttcatttagtatagtccatcgattgtatatccgtccttttgatggccttttgagttgtttcccatttgcggttatgaaataaagctgctataaacattcttgtacaattctttttgtgatcatatgttttcgtgtttcttggagaaatacttaggaggggaattgcgagtttggaagtaaaaagtagctgtattttgaactttttcagaagctctgagttttccagagcggttgtaccattttacactccaactagcaaggtatgggagttattatggttgtgccacagccttccggacattaggtattgtcagtctttctaatgtggtatatccttgtggttgtaatttacagttctctattgactaaggatgttcagcattttttcatgtgcctattggccattcgtattttgtttgtaaagtagctcttcgagtcttttacctgttattttggttttttgtttgtttttattgttcagttgtgggactgctttatacattctggatacaagtcctttatcagatccatgtgtcgtgaatgttttcttctgatctgttgcttgcctatttgtttgctttacagagtttacagtatcttaagaggagtggatttatcttttttatgttcagtatttgccttgtcctgtttaggacatctttttttttttttttaaccccagggtcatgaagatattatcttacattttcttttaggacctttatggttgtaagttttacagtaaggtccttgagccattaattaattcttaaaattaattgtttatggtgtgaggtgtaggagtcagtctctggtatctttcctgtatggaaatccagttattctgtctccacttgttgaaataggcttcctttctctactgaatgcttttaattttaattattttacagttggagtatagggctaccattttagtgctattttctttttttctttgttaatttttgagacagggactcacactgttgcccaggctagagtacaatggcacaatcaaggcttactgcagcctcgaacccctgggctcaagcagtcctctagcagcctcacgagtagctgggattactccaccacacccagctaactattttatttttttgtattgacaggatctcactatgttgcccaggctggtctcaaactgctggcctcaagctttcatcccatctcggcctcccaaagtgctgggattacaggtgtgagccaccatgcctgacctcttagtgctattttctatttatctcctctgttctctgctctctttaaacgttggaggaagaaacagtacccatcttacacaaactcttcagaaaacagaggaacagactgggcgcggtggctcatacctgtaatctcagcactttggtacgctgaggcaggggatcatttgaggtcgggagttcgagaccagcctggccaacacggcgaaaccccatctctactaaaaatacaaaaagtagctaggcgtggtgacacatacctgtaatgccagttactcaggaggctgaggcacaagaatcccttgaacctgggaagcggaggttgcagtgagccgagattgcgccactgcactccagcctgggcaacagagtgagaccctgtctcagaaaaaaaaagaaagaaagaaaaaatagaggaatatttcccaacttgttttcgaagccagcataatcctggtaccaaaaccaaacaaggacattataagaaaagaaaatatagaccaatattcctgttagcatagacatgcaacagctaaccaattttagcaaaccaaacctggtaatatagaaaaaaggataaataggccagtcgcggtggctcacgcctgtaatcccagcactttgggaggctgaggcaggcagatcacttgaggtcaggagtttgagaccagcctgaccaacatggtgaaaccccgtttctaataaaaatacaaaaatcaggctgggcacggtggctcacgcctgtaatcccagcactttgggaggccgaggtgggcagatcacgaggtcaggagttcaagaccagcctgaccaatgtggtgaaacgccatctctactaaaaatacaaaaatcagccggtgtggtggcacctgcctgtaatcccagctactcaggaggctgaggcagaattgcttgaacccgggaggcagaggttgcagtgagccaagatcgtgccactgcactccagcctgggcgacagagcaagacttcatctcaaaaaaaaaaaaaaattagctgggcatggtggtgggcacctgaaatcccagctactcgggagtctgaggcaggagaatcgcttgaacccaggaggcagaagttgcactgagctgggatcacaccattgcactccagcctgggcaacagagtgagactccatctcaaaaaaagaaaaagaaaaaggataaatacattctaaccaaataatgtttatctcatgattgtagctgattcaacattcaaaaattggcctggtgcagtagctcaggcctgtaatcccaacattttaggaggctgaggcaggaagatctcttgagcccaggatttcaagaccagcctgggcaacatagtcagactggtctttactggggggaaaaaaatcagtctgtgtaattcaccacattaacaaagggaaacataaaaaccctatgatcatttcaacagatgtagcaaaagcagttaatgatattcaacacatatgcatgattacaaaccaaccaacctcctagcaaactagggaaaggaaacttaacctagtttgataacagggcgtccacagtcggagttccactagcagcatacataatggtagaaaactcagtgctgccgggcgcggtggctcacgcctgtaatgccagcactttgggaggcctaggcgggcggatcacgaggtcaggagatcgagactgtcctgactagcatgctgaaaccccgtctctactaaaaatacaaaaacaaaaaattagccgggcatggtggcgggcgcctatagtcccagctactcgggaggctgaggcgagagaatggcgtgaacccgggaggcggagcttgcagagcctagatcgtgccactgcactccagcctgggtgacagagtgagacttcgtctcaaaaaaaaaaaaaaaaaaaaaagaaaagaaaactcaacgctttttcctctaagatcaggaactagaaaaggatttgactctcacaacgttgataccatactggaggttttaaccaggcaagaaaaagaaataatgagggccgggtgcggtggctcaggcctgtaatcccagcactttgggaagccgagacgggtggatcacgaggtcaggagatcgagaccatcctggctaacacggtgaaaccctgtctctactaaatatacaaaaaattagccgggcgtagtggcgggcgcctgtagtcccagctactcgggaggctgaggcaggagaatggcgtgaactcagggggcggagcttgcagtgagctgagatcgagccactgcactccagcctgggcgacagagcaagactgtgtctcaaaaaaaaaaaaagaaaaagaaataatgattagtggcccgatgtctcacgcctataatcccagcactttgggaggccgaggtgggcagatcacctgaggtctggagttggagaccagcctgacaaagatggtgaaacctcgtctctattaaaatattaaaaaaatagccaggcgttggccgggtacagtggctcatgcctgtaatcccagcactttgggaggccgaggtgggtggatcacctgaggtcaggagttcaacaccagcctggccaacatggtgaaaccccatctctactaaaaatacaaaaattagccgggcgtagtggcgggcgcctgtaatcccagctacttgggaggcttaggcaggagaatcgcttgaacctgggaggcggaggttgtagtgagccgagattgcaccattgcactccagcctgggtgacaaaagcaaaaactccgtctcaaaaaaaaaagaattagccaggggtagtggtgaacgcctgtagtcccagctactcaggaggcagaggcaggagaatcacttgaacccaggaggcagaggttgcagtgagccgagattgtcccattgcactccagcctaggcgacaagagcaaaattccatgtcaaaaaaaaaaaaaaaaaaggaaagaaaaaaaataacgattagaaaggaagaaataaaacacattcacagccagtatgattctatacatacatgtcctaatggggccaggcgtggtggctcatgcctgtaatcctagcacttttaggaggctgaggcaggtggcttccctgggaccagcctggccaacatggtgaaaccccaactctaataaaaatacaaaaaatcagccaggcgtggtgacgggcacctctaatcccagctactcaggaggctgaggcaggagaattgcttggacctgggaggcagaggttgcagtgagccgagatcgcgctattgcactccagcctgggcaacaagagtgaaactccggcagggtgtggtggcttacgcctgtaatcccagcacttcgggaggctgaggcaggccgatcacctgaggtcaggagtttgagaccaacctaacatggtgaaaccccgtctctactaaaaatacaagaattagctgggtgtagtggtgggcgcctgtaatcccagctacttgggaggctgagacagaagaattgcttgaacccaggaggtggaggttgcagtgagctgagatcatgccattgcacaccacgccgggcaacagagcgagattccgtctcaaaaaaaaaaaaaaagagtgaaactctatctcaaaaaaaaaaaaaagtcctaatggaaaatccataaaaagctaccaaaactaataaataaatatagcagggttgcaggttacagggcaatatagttatccctctatctgtaggggcttggttctgggactcctcacacaccaaacccacagatgtctaagtcccatatataagacggtatagtatttggatttaacctacacatatcctcccatatagtttaaattatctctagattacttacattacccccatacaatgaaaatgctaatgtacatgcaagtatgtatgtaagtacttgtactatattgtttagggaatcactggacatataggccttcaagactgataccagcagccactgttaagattctggtcaggcctgcccctgtttggggtctcagttgatctcattgccttcccacccagccaagggcacctgcatttctcttggctccctggccatttggaaggcctagttcagcctggcacatttgtatcctggcccactgatgctggtacccctgggaaggtcctgctctgaaaaacacggagattttagttgctactgaagatttgagagataaagacagggagacctgtctgtagacctgtgtccctccaagtgggattgagactttgggccccccatttcaggacagcacctcctggcctgttgactgaatagatccctgaaggaggtgtacttgcattaatggagtgggggtgggagcagtaccacagatccgcactaacaatcacacagttctctctagaataataatatagaacaagtgaaatagaacaattgcagaaagagctaacctttgttgagctcttactgtgtgcccagcactttcctcaactctacatttcccataatacacagagtactaggtaggccaggcttggtggctcacgcctgtaatcccagcactttaggaggccaaggggggtggatcacctgaggtcgggagttcaagaccagcctgaccaacatggtgaaaccccgtctctactagaagtacaaaattagccaggtgtggtggcacatgcttgtagtcctagctactcagcaggctgaggcaggagaatcatttgaatccgggaggaggttgcagtaagcggagatagtgccactgtactccagcctgggcaataagagctgagactccgtctcaaaataaaataaaataaaataaaataaaataaaataaaataaaaaaagaaaagagcctgccattaaaggagctgtttggtaggggatgttttgtcagtgcaaacaacagaaaagtgggctgggcacagtggttcatgcctgtaatcccagcactttgggaggccaaggcgggcggatcacctgaagttgggagttcaagaccagcctgaccaatatggagaaaccccgtctctactaaaaatacaaaattagccgggcgcagtggcgcatgcctgtaatcccagctactcgggaggctgaggcaggagaatcgcttgaacctgggaggcagaggttgcggtgagccgagatcgcaccattgcactccagcctggacgagagcaaaactctgtctcaaaaaaaaaaaaaaacagaaaagtgtaacaaacacttacagtaggcatgtttcttagcaaatctgatgacaaatttggcataaagaaagagagcatccctgaaaaaaaaaaaaagaaaaagaaagagagcatcctgcctgggcaacatagtgaaaccctgcctctacaaaaaaactcaaaaattggccgggtgcagtggctcacacctgtaatcccagcactttgggagtcggaggcgggaggatcacctgaggtcaggagttcgaaaccagcctggccaacatggcaaaaccccatctctactaaaaatacaaaaaattaatcaggcgcattggtgggcgcctgtaatcccagctactcaggaagttgaggcaagaggatcgcttgaatctgggaggtggaggttacagtgagtcgagatcacaccactgcactctagcctgggtgacagggcgagactccgtctccaaaaaaaaaaagaaaaagaaaaagactaaaaaattagccaggcaggcctctgtggtcccagctacttgggaggctgaggcaggagaatcactgagcccaggagtccgaggctgtagtgagccatgattgcaccactgtaccctagcttgggcaacaaagcaagaccctgcctcaaaagaaaaaagaaagaaagaaagaacatggcgggccaggcacagtggctcacacctgtaatcccagcgctttgagaggccgaggcaggtggatcacaaggtcaggagttccacaccagcctggccaacatggtgaaaccctgtctctactaaaaatacaaaaaatcagccaggcatggtggcaggggcctgtaatcccagctactcgggaggctgaggcaggagaattgcttgaaaccagaaggcagaggttgcagtgagcctagactgcaccactgcactccagcctgggcgaaaagagccaaactccatctcaaaaaacaaacaaaaaaacaaaacaaaagaaaacatggcaaagcctttgaaagcttgtctgggagaaggtgcgatgatagttgcataacttcgtgcaagatgctggtccacacaggggctgccccttgctctttctcgctctcttaacctctcatataacaggcttgtgtgttattcacatttattgagcccaagcaggtgcaaggcattgtgatctaatactttggtcagcaagacaacaagatagatcactgccctgcccttaggaagtgtatatgctattagaggaaacagataaaataaacaaggaaaagtatcagacaatgtaagtgctatgagaatgcaaatgaggtgatgtgaattaaaataggatgacttaaagtctgcacgggaaggagcctacccccatgttcctggctagccaaggaaccaccagttgattagcagagaagggcagccagtctagctagagcttttggggaagagggagtggttgttaagagatgagattaaagaagccgagacgggccattcgtgaggggtttgtaatgcagggctgaggagtgtccgaagagaatgggcaggtgagcggtgagacagttgttcttccagaagctttgcagtgaaaggaatcaaagaaatggagccgtgtatcaggtggggaagggtgggggccaagggggtgtccttccccatacagagattgcaggctgagaatgactatatccttgttaacaggaggtgggagcagggcacggtagctcacacctgtaatcttggcactttaggaggctgaggcgggccgatcacctgaagtaaggagttcgagaccagcctggccaacatgcaaagccctgtctctactaaaaatacaaaaattagctgggtgtggtggtactcgcctgtaatcccagctactcgggagactgaggcaggagaatggcttgaacccggaaggtagaggttgcagtgagctgagatcatgccactgtgctccagcctaggtgacagagagagactccatctcaaaaaaaaaaaaaaaatacaggaagggagttgggaatagggtgcacatttaggaagtcttggggatttagtggtgggaaggttggaagtccctctctgattgtcttttcctcaaagaagtgcatggctggtgaggggtggggcaggagtgcttgggttgtggtgaaacattggaagagagaatgtgaagcagccattcttttcctgctccacaggaagccgagctgtctcagacactggcatggtgttgggggagggggttccttctctgcaggcccaggtgacccagggttggaagtgtctcatgctggatccccacttttcctcttgcagcagccagactgccttccgggtcactgccatggaggagccgcagtcagatcctagcgtcgagccccctctgagtcaggaaacattttcagacctatggaaactgtgagtggatccattggaagggcaggcccaccacccccaccccaaccccagccccctagcagagacctgtgggaagcgaaaattccatgggactgactttctgctcttgtctttcagacttcctgaaaacaacgttctggtaaggacaagggttgggctggggacctggagggctggggacctggagggctggggggctggggggctgaggacctggtcctctgactgctcttttcacccatctacagtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacggtcagttgccctgaggggctggcttccatgagacttcaatgcctggccgtatccccctgcatttcttttgtttggaactttgggattcctcttcaccctttggcttcctgtcagtgtttttttatagtttacccacttaatgtgtgatctctgactcctgtcccaaagttgaatattccccccttgaatttgggcttttatccatcccatcacaccctcagcatctctcctggggatgcagaacttttctttttcttcatccacgtgtattccttggcttttgaaaataagctcctgaccaggcttggtggctcacacctgcaatcccagcactctcaaagaggccaaggcaggcagatcacctgagcccaggagttcaagaccagcctgggtaacatgatgaaacctcgtctctacaaaaaaatacaaaaaattagccaggcatggtggtgcacacctatagtcccagccacttaggaggctgaggtgggaagatcacttgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtgagcagctggggctggagagacgacagggctggttgcccagggtccccaggcctctgattcctcactgattgctcttaggtctggcccctcctcagcatcttatccgagtggaaggaaatttgcgtgtggagtatttggatgacagaaacacttttcgacatagtgtggtggtgccctatgagccgcctgaggtctggtttgcaactggggtctctgggaggaggggttaagggtggttgtcagtggccctccaggtgagcagtaggggggctttctcctgctgcttatttgacctccctataaccccatgagatgtgcaaagtaaatgggtttaactattgcacagttgaaaaaactgaagcttacagaggctaagggcctcccctgcttggctgggcgcagtggctcatgcctgtaatcccagcactttgggaggccaaggcaggcggatcacgaggttgggagatcgagaccatcctggctaacggtgaaaccccgtctctactgaaaaatacaaaaaaaaattagccgggcgtggtgctgggcacctgtagtcccagctactcgggaggctgaggaaggagaatggcgtgaacctgggcggtggagcttgcagtgagctgagatcacgccactgcactccagcctgggcgacagagcgagattccatctcaaaaaaaaaaaaaaaaggcctcccctgcttgccacaggtctccccaaggcgcactggcctcatcttgggcctgtgttatctcctaggttggctctgactgtaccaccatccactacaactacatgtgtaacagttcctgcatgggcggcatgaaccggaggcccatcctcaccatcatcacactggaagactccaggtcaggagccacttgccaccctgcacactggcctgctgtgccccagcctctgcttgcctctgacccctgggcccacctcttaccgatttcttccatactactacccatccacctctcatcacatccccggcggggaatctccttactgctcccactcagttttcttttctctggctttgggacctcttaacctgtggcttctcctccacctacctggagctggagcttaggctccagaaaggacaagggtggttgggagtagatggagcctggttttttaaatgggacaggtaggacctgatttccttactgcctcttgcttctcttttcctatcctgagtagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgaggtaagcaagcaggacaagaagcggtggaggagaccaagggtgcagttatgcctcagattcacttttatcacctttccttgcctctttcctagcactgcccaacaacaccagctcctctccccagccaaagaagaaaccactggatggagaatatttcacccttcaggtactaagtcttgggacctcttatcaagtggaaagtttccagtctaacactcaaaatgccgttttcttcttgactgttttacctgcaattggggcatttgccatcagggggcagtgatgcctcaaagacaatggctcctggttgtagctaactaacttcagaacaccaacttataccataatatatattttaaaggaccagaccagctttcaaaaagaaaattgttaaagagagcatgaaaatggttctatgactttgcctgatacagatgctacttgacttacgatggtgttacttcctgataaactcgtcgtaagttgaaaatattgtaagttgaaaatggatttaatacacctaatctaaggaacatcatagcttagcctagcctgctttttttttttttttttttggagacagagtctcactctgtcacccaggctggagtgcagtggcgggatctcggctcactgcaacctccgccttctgggttcaagcgattctcctgcctcagcccactgagtagctgggattacaggcacctgccccgacgcccagctaattttttgttatttatttatttttttttttagtagagatgaggtttcaccatgttggccaggctagtctcgaactcctgaccttgtgatctgcctgccttggcctcccaaagtgctgggattacaggcgtgagccaccgcacccggcctgcctagcctacttttattttatttttaatggagacagcatcttgctctgttgcccaggctggattacagtgatgtgatcatagctcattataccctcctgggctcaagcaatccccctaactctgcctccccagtagctaggaccacaggcatacaccaccatacccagctaatttttaaaattttttgtagatagatagagtctcactatgttgcccaggctggtctctagcctacttttttgagacaaggtcttgctctgtcacccaggctggatagagtgcagtagtgcagtcacagctcactgcagcctccacctcccaggctccatccatcctcccagctcagcctcccaagttgcttcaactacaggcctgcaccaccatgcctggctaatttttatttatttatttttattttattttattttatttttttgagactcagtctcactctgtcgcccaggctggagtgcagtggcatgatctcggctcactgcaacctctgcctcctgggttcaagtgattctcctgcctcagcctcccgaatagctaggactacaagcgcctgctaccacgcccagctaatttttgtatttttagtagagacagggtttcaccatgttggccaggctggtctcgaacttctgaccatgtgatccgcccgcctcggcctcccaaagtgctgggattacaggtgtgagccaccacgcccggctaatttttatttatttatttaaagacagagtctcactctgtcactcaggctagagtgcagtggcaccatctcagctcactgcagccttgacctccctgggctccggtgatttcaccctcccaagtagctaggactacaggcacatgccacgacacccagctaattttttattttctgtgaagtcaaggtcttgctacgttgcccatgctggtatcaaacccctgggctcaatcaatccttccacctcagcctccccaagtattggggttacaggcatgagctaccacactcagccctagcctacttgaaacgtgttcagagcatttaagttaccctacagttgggcaaagtcatctaacacaaagccctttttatagtaataaaatgttgtatatctcatgtgatttattgaatattgttactgaaagtgagaaacagcatggttgcatgaaaggaggcacagtcgagccaggcacagcctgggcgcagagcgagactcaaaaaaagaaaaggccaggcgcactggctcacgcctgtaatcccagcatttcgggaggctgaggcgggtggatcacctgaggtcaggagttcaagaccagcctagccaacatggtgaaaccccgtctctactaaaatacaaaaattaaccgggcgtgatggcaggtgcctgtaatcccagctacttgggaggctgaggcaggagaatcgcttgaaccaggaggcggaggttgcagggagccaagatggcgccactgcactccagcctgggcgatagagtgagactccgtctcagaaaaaaaagaaaagaaacgaggcacagtcgcatgcacatgtagtcccagttacttgagaggctaaggcaggaggatctcttgagcccaagagtttgagtccagcctgaacaacatagcaagacatcatctctaaaatttaaaaaagggccgggcacagtggctcacacctgtaatcccagcactttgggaggtggaggtgggtagatcacctgacgtcaggagttggaaaccagcctggctaacatggtgaagccccatctctactaaaaacacaaaaattagccaggtgtggtagcacacgcctgtagtcccagctactcgggaggctgaggcacaagaatcacttgaaccccagaggcggagattgcaatcagccaagattgcaccattgcactcccgcctgggcaacagagtgagaccccatctcaaaataaataaataaatatttttaaaagtcagctgtataggtacttgaagtgcagtttctactaaatgcatgttgcttttgtaccgtcataaagtcaaacaattgtaacttgaaccatcttttaactcaggtactgtgtatatacttacttctccccctcctctgttgctgcagatccgtgggcgtgagcgcttcgagatgttccgagagctgaatgaggccttggaactcaaggatgcccaggctgggaaggagccaggggggagcagggctcactccaggtgagtgacctcagccccttcctggccctactcccctgccttcctaggttggaaagccataggattccattctcatcctgccttcatggtcaaaggcagctgaccccatctcattgggtcccagccctgcacagacatttttttagtcttcctccggttgaatcctataaccacattcttgcctcagtgtatccacagaacatccaaacccagggacgagtgtggatacttctttgccattctccgcaactcccagcccagagctggagggtctcaaggaggggcctaataattgtgtaatactgaatacagccagagtttcaggtcatatactcagccctgccatgcaccggcaggtcctaggtgacccccgtcaaactcagtttccttatatataaaatggggtaagggggccgggcgcagtggctcacgaatcccacactctgggaggccaaggcgagtggatcacctgaggtcgggagtttgagcccagcctgaccaacatggagaaaccccatctctactaaaaatacaaaagtagccgggcgtggtgatgcatgcctgtaatcccagctacctactcgggaggctgaggcaggagaatcgcttgaacccgggaggcagaggttgcggtgagctgagatctcaccattacactccagcctgggcaacaagagtgaaactccgtctcaaaaaagataaataaagtaaaatggggtaagggaagattacgagactaatacacactaatactctgaggtgctcagtaaacatatttgcatggggtgtggccaccatcttgatttgaattcccgttgtcccagccttaggcccttcaaagcattggtcagggaaaaggggcacagaccctctcactcatgtgatgtcatctctcctccctgcttctgtctcctacagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 39 - DNA, 14144 bp, Sus scrofa
aaaagtccagggccaccatccttggcgcaggtagctgctggtctccggggtcacctgacgtcccgtctcgagcgtgcatcccaggacagtgacacgctctcctgagcttcgggtaagctcttaactgagcctgatgaatactctatgagtcatgggctctcgggtctgtgtattttcagctcagaagaaaggaggatggaggtggagcgaaagatttagtgatttgggggggggggggaaatggaagttcttctagcggcatcaacagaggaatgcaatgttgggaggcctgagtgtagatgatagggatgttaggaccaaccgaactaaaaagctgaacacctgcgccgggtagtggggctttggggaaaacttgagcctgcctaaggggttcttccccaccaccgccaccaccccatttcagtacccggtgtgggggagcccttaataagacacacaaagcatcaaggtccgaggctttgggatcttggaactttggggatttatggctcgagattttagtgcgtatggcatcccagtggaaccctggactccattccgaagtggttatccggagtgctccgggaagtccaaggtgctaacttccggacctttgtcctttcttgagtgaactttccaactggccttcagcgcctcaggatggagaaagtccatttaaaggctgtcagttgtggaaatgggacatgctaaacaagaggtttgcccgcgaagcctcggaggagtaacccggccggagaggcccgggagccctgttattgtttggctctgcatttacatttctgccactcgcaggagcatttccggtttcttttcttcggaacagcccactattcacccgatgtgagggaagtagaaagagaaaaggtcttttaaactggttcctattgcttgctgcaaggggctgttaaccccctctaccttttttttgtccttcatggactacttagccaccgcttttgggaaggaaaaagcatttgttatgatgcaaacctcagtccctccccctcttgtgaatggtgtgctccttcctggttgtctgctaaccaggcggacgctaccattgcctggggcggttttcttttctttaaatatcagaaggcaaaccttgggtatcttcgagaatgggtacatctgagatttaaacgataaaaaagcataacgatggggttgtttgtttgtggcagagaaacaatttcttctgtatccggctttgggctgagccatccccattttcggacgcagaatgaacgtcgtgaaagcggaaggggcggggcttggagaggggcggggacggagctcccaagtgcagccctccggtcccggctagttctcgcctgcgggaggcggcttgaccccgcgcggagtccgtcgaatgctctcctggggcatcttcaccatttagggcgcggtcgcctacctcgcacctgctgcgaatcagactctgtgggcggtacttacgcgctttttttctaaatcgaggtagcatttacactcacctcctatcaaaatacaagtctcatgcttctttccagtttatctttaaccctccaccttcattttgatttctgtcctcatggaatagttttgcctgttggagaactgctttataaatggaatcatacaggtcgtgctcgtttgtgtcagacttctttccttcagcaaaatctttgtaatgcacccattttattgcatgtgtcagtggtgtatcagtatcttgctccttttcatttaatgtgttgcactggatgaataaaccatccattgtttatccattctcctcgtggtggccttttgagttgtttcctgtttgggattagttttaataaagctgctcttgacattcttgtacagttctttttgtggtcatatgtttttatgtttcttggatatatacttaggagtagaattactaagtcatagagtagggaatacatctatgcgtttttaaattttatttaaaaattctgaagttcccactgtggcacacagggttaaggacctggtgtctctgcagcagctcaagtggctgttgtggtgcaagttccatccacgcctggctcagtgggttaaggatcttacccgggaacttccatgtgccacaggtgcgaccatacaaaaaattttttaaataaaagattctcattattcaaagtagttgtaccattttacacttccaccagcaagatgtatcctgcctcggtgtttggtttgtcagtggttctaatgtggcatatcactgtggttttaatttgcagttctctgttaactgtgttcagcaatttgtgcttaatggccatttctgtgtcatatgtcaggaggctgttcaaggagttccctttgtggctcagggtaatgaacctgactagtatccatgaggctgcggattcaatcccggcctcactcaatgtgttaaggatccagccctgctgtggtataggccggaagctgcagctctgattggacccctaacctgggaacttccatgtgccgaaggtgctgccctaaaaagaccaaaaaaaaagagagagagagagaggctattcaagtcttccccattttaaacattggtttatttgctttttgtattattgagttgatggaattatttgtgtattctggatggaatattttttgttgtcggatacatgtgttttctcctagcctgttgcttgcctataagagccctaagagtagcagaagattcttttctcttgttagtttgttttggcctgtttaggaaatcttaaccccaagatcatgaagatattctcttatattttcttctagaacctttgtggttttaggttttacatttagatctatgagccataagaaattaacaaattagggagttcctgtcgtggctcagtggttcacgaatccgactagaaaccacgaggtttcgcgtcctatccctgcccttgctcagtgggttaaggatctggcgttgctgtgtgagctgtggtgtggatcacagacacggctcggatcccagttgttgtggctgtggggtaggccggcggctatagctctgattagacccctagcctgggatcctccatgtgccttgggtgcagccctagaaaatacaaaaaaaaaaaaaaaaaaaagagcattccccaagtcaggttagcattaacaccatacctaatagtgacagactgaatgctttttctctaaggtcaggaactagaaaaggatttgactctcaccacttcagcattataaactgcaggtcttaaccaggcaagaaaaagaaagaattcccttgcagcgtagcaggttaaggagccattgttactgcagcagctctggtcacttctgtggcatgagttcaatccctggcccaggaacttccatgtgcctcgggtggggccaaaaagaaaaagacgtaggagttcctgttgtggcacagtggaaaccaatccgattagtaaccacgaggttgtgggtttgatccctggccttgctcagtgggttaagaatactatgcactgagctgtggtgtaggtaacatactctgctcgaatctggtatttctgtggccgtaggccagcggctacagctctgattcgacccctagcctgagaacctctgtatgctgtgggtgcagccctaaaaagcaaaaaaacgaaagtaaatgttaacagttgcaaaagaaaacattgctttattcagatgctataattgtgtacacaaagtgattatagcaaggttacaagtttgaaaagcaatatgcggaaattttatttttgtagcaaccttgaatctgaagtcaaaaaatgaattttaaaaacaattccaggagttccctggtggcctgatgggttaaggacctggcattgtcactgctgtgactggggttggatccctgcagggaacttttgcaagccacgggcacagccaaaaaaaaaaaaaaatgctatttacaatagcattgaaaaacatggtggagttcccgtcgtgactcagtggttaacgaatccgaccaggaaccatgaggttgcgggttcaatccctggcctggctcagtgggttaagaatccggcattgccgtgagctgtggtgtaggtcgcagatgtggctcagatcccacattgctgtggctctggcataggccggcggctacagctctgattagacccctagcctgggaacctccatatgccacggtagcagtcctagaaaaggcaaaaagacaaaaaaataaaaataaaaagtatttaattcagtgttttaaaacaaccctaccaggcttggaggtcccactgtggcatagtagtttaagaagccagtgttgccacagctgtgccataggtcatagctgtggctcagattcgatccctggccctagatcttccaatgtcgtgtgtgtgtgtggccaaaaaaaaattaaaaaaagatatataaaattaaaaattaaaaaaattaaaaaaagatatatatatctcctcacaggcttgtttgtggaagttgccaagctgattccaaaatgaaacaataaatagtgcagagttggaggtcttaaaacacctgtcttcaagattactataaaattaagtggcgtttctattgtggctcagcagtaaagaacccagctagtatccatgaggactcggcttcaatctctggccctgcctgatggcttaaggatctggtgttgccatgagctgccctgtaggttgcagacatggctcagatctggcgtttctctgtctgtggcataggcgggctgtgactggacccctagcctgggaacttccttccatatgcagcaagtgtggctgtgaaaaaagaaaaacaaacaaaaaacagtctgatggcatttcaactgatatacatttggcctcacaaagctttgtgtggttgtggagagtggctaggggtatagatgagacaataacgcagaatgttgattattcttgaagcttagatgtgggtaaatggggggacattattctgtttacttttttatgaggttaaaattttccataatgtttgtttatctttcttttttagatgtttttattttggaaaaatgcagacagatacaagagtaacaacatatttccccaccaaaattttttcttttttgtctttttgtctttttgccatttcttggaccgcttccacggcacatggaggttcccaggctaggggtctaatcagagctgtagccgccagcctacaccagagccacagcaacacgggatccaagccgcatctgcaacccataccacagctcacagcaacatcggatccccaacccactgagcaaggccagggatcgaacccgaaacctcatggttcccaggcggattcgttaaccactgagccatgatgggaactccaccaccaaataattttaacacttaatattttgtccatattttaatgtatggattttttttttttttttttttttttgccacacccacagcatgcagaagttcccaagccaggaattgaactctcgccacagcagtgacaacgccagatccttaaccagtaggccaccagggaacttctggatgccgtctttttaaatttttctttgttaataaagttaaaactccctttgactatactcctagtatcataagcacacatccctcctctccctgagaacgtcactatcatggattttgtgaatttttattcttcttgcctatctttataatttcacgtgcatatgtgtataagcaatagtcattgtatattttttgatttcacaattaaattaaaatgactgtgttttgctttttttcttgcaaattatcttttcaccccatgtgtttctgagctgtatctggttccacatacagataattcacttccctaaaccactgcagtaaatttctcctgtgagtgaacacaccgtgtttcctttatctcctccctactgatataaggttgtttcttgtcacctgccatcaggaacaacgatgacatgaacattttggggcaaggctcctgctcctgccgcctgcaaccatttttccagggagtccatctaaaagtggttttgctaagtagtaagatgtatgtgttttcagttttaccagaggctgccttgtttcttcccagaatcaattgttttttcccctatcacatggctttcagccagatgtttttttccatcagacttctgggtgaagccaggggagccgttatttagagcttgggtgtgggagttccctggtggcccagcagttaaaggacctggccgttgtcactgctgtgacgcagcttcgatccccggcccgggaacttctgcatgccacaggtgagggcaaaaataaaaatgaaacgtagggcttggctgtggcctcggatagcccaggttcatattcctgcctctgccccttgggagctttctgggcctgagtaattcctttaacctcagttccctcctctgatgatacagcacctgcctcactggctttttgagaggattaatgagataagccagcgaaagctgtgggtccagatagggtctgttttcgcagcagccttgttgttctgataatgggcaggcctgccctgcctttgagtccagccgagtttattgccttcccacctggctgccgccccgatcagcttagccggagagtctggttcctcttctgacagtttaagatcatgaccccctgatgttcagacccatggaaagcacctactctgaagaggtttcctagagaaaagaacattgaaaatttagttgctaccagccactgagggagagacacctcctatgtccatggggctgtctccccctcagtgggcctgagaccctgacccaccatcccccgacagcccacatacccacgggtttattgaacacggggttgcgggaaagaagtgagctagcacagatgtgggcagaaccacaaaaaccccacccccctgcaatcacagagctctcgctctcaataatagagaaccaggagttcccactgtggttcagcagtaacgaacccgaatgggctccatgaggacgcaggttcgatccctggcctcactcagtgggttaaggatccggtgtcgccatgagctgagctgtggtgtaggttgcagacatggctcggatcccgagttactgtggctgtatcgtaggctggcggctctagctctcattcagcccctagcctgggaacttccatatgccacaggtatggccctaaaaacgtatatatatatctggcccttttctcaacgctacatttcccttaataactggagtactatcttagagctgaggacacttaagggacagagacgttaagcaaccgcccaaagttacacagctattccatggtgagcttgggatgcaggcctagcgcatctgcctctagagcccgtgctctgccatctttgccctgggagctttgatgagtgaaatcatgcagtgaatttaagtgatgatacaacatcaaacccagggcttccgacttctaagccccatctctgtttacacaagcctcccttccataaaaacctcaaagttatttttatcctcaatttagagagggggaccctggtccttccccccaaggcaaatatttagagtcccactgctgtcccctcttgccttccttcgtgcacgttcatggcctgtcccctgtcatcattgggagctatataagtggccctttgccggcctctgactttcatcagctaaaatctgcacctctagacgtaactgatgacaaaagttacgttatgcaaagtcatcttaatccttaatcctaggcattcaaatggtcagttttttgtaaaagctccttcactaacctgtgcattgcaggctgctcccttaacctctctgagactgtcaagaatcaggtgtgcttagcgagacagacaacccatgtagaaagggtttgcacactctaaataaagcagaaagcaggccctaggtcaacataaaggagcgagtgaatattagaggagattagaaaacagctgcttgttggagttcctgtcgtggcacagcggaaacaaatccaattaagaaccatgaggttgcaggttcgatccctggcctcgctccgtgggttaaggatcgggcattgctctgagctgtggtgtacgtcgcagatgtggctcggatctggtgtggctgtggctgtggtgtaggccgacagctgtacctccgattggacccctagcctgggaacctccatatgccgtgggtgcagccattttaaaaaaaaaaaaaaaaaaaaaaaagctgcttgctgcgggtggggcggtggggaggtgttttcagtgccattacattaacacagaaggagaagagtaatggcagggatttttgcagcgagcataattctgagcaaagctgatgacagatttggcttcgagaaagatggcatgatgaaaccatttgaaagctgagctgggagatgagatgatagaggcatagcctagtgcggggccctggcccagaccacacagctacccctcggtcctccctcgtacccttgaccaatgataaccagctcacagcctgggcacaacaattcattcagtcaccacggtgactgagccccgagcaggtgcagggcagtatgctaatagctggcgaaggagatgcttccctgccctgaggaagtttatatcccagcagcacacacagagcgagcgagaaaggtcagcaggtagtgtaagcacgaggagcactaacaacagggtgacctgaattcgaataaggtgacagagtttggctggctgtccttgatcgatcgagcggtctgggtccctgctgaggtgtgaccctcaggatggggtcccagtgagaaggagcttgcccttcagtgatggcaggaccactgttcccaggagtgaaatgaaccagcgaaggtccgccgtgcaggaaagggcagccactgccgctcgagcatcgggaagggagagggtgctagaagatgagatcagagaggtgggcaggggctgggtggtgaggaatttgtatgccaaggtggggggggccggccccaagggagcaggggggaacgtgggggggccagggaggcatctccccctgccccgccctgaccgcggtggagggacagggctgagttacttcatcctgattcccacagaggagggcagacatgggtacacgtggcggaaggcttgtggattcagtggtggaagggtggacaatccctctctggttatcttttccccgcggggatgtgcgtggtgaggggtggggcaggtgcagcctggcatgtgaagggcagggcgctgccccagcagcagagcctcaccacgggtgagtgtggacggagggggtccctcttccctcggggcttgggtgtgtctcaggctggatcctggcctttctccccacagcggccacactcccctccagggagctgcaatggaggagtcgcagtccgagctgggcgtggagccccctctgagtcaggagacattttcagacttgtggaaactgtgagtggagtctcaagggagggctgcccgtcttctaataaccttgcttccccccccaccagcccccagcccccaaccccagtagaggcctctgggaagcacagacctatactgactctctgcccttgtcttccaggcttcctgaaaacaacctgctggtaaggactggggcgcggcaagggcaggggcctggggggctggggggctggcctcctgactcctgttgttcccatccatccgcagtcctctgagctctccctggcagcagtgaacgatctgctgctgtccccagtcacgaactggctggatgaaaatccagatgacgcctccagagtgccagcgcctcctgcagcaacagcgcccgcaccagctgcccccgcaccagccacctcctggcccctgtcgtcctttgtcccttctcagaagacctaccctggcagctatgatttccgtctagggttcctgcattctggaacagccaagtctgtaacctgcacggtcagtggccttgagggactggcttcgtagggacagtgcctggcccctatccccccgggtttttctgtttagaacttcgtggttccactgcagcctttggctttgtgtcaggctttctatgtttaacctatttggtctatgaccttggaccctggtcccaaagttgaatactcccacttgaccttggcctctcatccttcccatcacactcttcagcatttgtcatgaggccatggaactttttttcttttctctccactcattcattccttggcttttgtaaggaagcttctgggagggagcccccgaccctgccatctctggctaccctccccaccgagcacttggctgctaatcagtatttaggcagcgtctgttcatttgactgctggctccctgtcctctgaccttctgttcgctctccatcctccctttcctgcagtactcccctgccctcaataagctgttttgccagctggccaagacctgcccggtgcagctgtgggtcagctcgccacccccgcctggcacccgtgtccgcgccatggccatctacaagaagtcagagtacatgaccgaggtggtgaggcgctgtccccaccatgagcgcagctctgactatagcgatggtgagtgggcgggggctgtgggtgggacagggctggtgccggagctgccaaacccctcattcccacccccaccccccgattgctctcaggtctggcccctccccagcatctcatccgggtggaagggaatttacgggccgagtacttggatgacagaaacacttttcgacacagcgtggtggtgccctacgagccgcccgaggtctggtttggcccctggggtctccgggaggagggggccagaggggtttgtccgtggccttcctggtgggagatggggcggctttctccttctcacttgacctgccgcagcctcgtgaggcgggtagaacagatgggttacccccattccacagctgaggcgcccagaggccagtggcctgccggggctagtagggtcaccttgggcctgtgtcgtcccccaggtcggctctgactgtaccaccatccactacaacttcatgtgcaacagctcctgcatggggggcatgaaccggcggcccatcctcaccatcatcacactggaagacgccaggtaggggccacacgccgccctccacgctggcgggcccctcctcagcctctgcctgtctccatggccctgccgctcatccccttctcccgggcttccagccatccttccctctggctgcagccactttgcgtccctctgctgctccctcccagtgcccttttccccggctttggcacccctcttacctgtggcttcttgatcagctggagctgaggctcctcgtaggatgcgggggatggggagggggtggggccccgctcacagagcagggaggccgggctggctttcctcactgcctcctacttccccccggggtagtggcaacttgctgggacggaacagctttgaggtgcgtgtttgtgcctgtcctgggagagaccgccgcacagaggaagaaaatttcctcaagaagggccagtcttgccccgagccgccccctggcagcactaagcgaggtaagcaggcaggaccaggaggggtagaggggacagggagggggcggttctgcccaaaatgcactcttttctcacctttcctcacctctttcccagcactgcccaccagcaccagctcctcgccagtgcaaaagaagaagccactggatggcgagtatttcaccctccaggtatcgagtctgggagagagaggggccgtttcctgctcttactcagtggggttggataaggggagaaaagctacaaaggtagcaggtgtgaggttatgcccagtttctctagccatcctttcgtctgttcatcggcttgactcttgtagtgcatattatctatcgggtttgagagattgaagtttcacttgggtcactccatatgttaatttcttcttgactgctttgcctgcatttggggcatttgccaacagggggcagtagtgccttgaaacagtggctttatttatttatttatctttttagggctgcaccctctgcatatggaggttcccaggctaggggtcaaatcggagctgtagttgccggcctctgccacagccacagcaatgcaggatcggagtctcttctgcaacctacaccagagttcacggcaacacaggatccttaacccactgagcaaggtcagggatcgaacccgtgtgctcatggatgctagtccggttcattactgctgagccacggctagaactccctaacataacattttaaagaaccctcttccaaaaagaaagttgttaaagagagcataaaaatagttcttgtgagaatttccttgtgcagcgagttaagaactggactagtatccatgaggagtccagttcgatccctggcctccctcagtggtaaggatcccaaaggtgtggcgtggctgtggctgtggctgtggtgtagaccagcggctacagctcagattggacccctagcctgggagcttccatatgccatgaatgtggccctaaaaagaaaaaaaagtagttcttatgactttgcctaatgctcctccaccccttccctgccacagatccgtgggcgtgaacgcttcgagatgttccgagagctgaatgacgccttggagctgaaggatgcccagactgcgagggagtcgggggaaaacagggcccactccaggtgagtgacccgcgtccctcccttgcattcctgcgttggaaagccgcgggggtccactctaaccctacaggtggtaaagggcagctgagcccctgctgttgggtccaacattcctccactttcttgcctccaggggtccacacgcctcttgagcccaggggcatgggatgttttctttcccacttctagcaacccttagaccctcagagctggggtcttagatgggggcctgatagccatgggagggtcagactcagcactggggggtcagatcctcagccctacaaagtactaaggagtcctgtgtggccttgttattcgccttctcaggctcagtttcctcattgtcacatgggataagggggcaatttcaaggttaatacctctaggtgctcagttagtaggtctgcagttggcagtgacttttttttttttttgtctttttagggccacaaccacggcacatggaagttccgaggctaggggtggaatcagagttgcagccactggcctatgcctcaaccacagcaatgcaggatccgagctgcatctgcaacctccaccacagttcacggcaatgccagatccttaacccacttagcgagcccagggatgaaacccgtgtcctcatggctactagctgagccacagcgggaactctaagcattttaacttaaattctcctccctcccgcctcaggccttgcaaagcccagctccaggaagaggggctcagagcctcccattgggataacatcatcccctcctctccccctctctcctcacagccacctgaagtctaagaaggggcagtctccctcccgccataaaaaaccgatgttcaagagagaaggacctgactcagactgatgcctcctgcatcccatccccttttgaagtccctggcattttggggactcaggtgcttagacctctgcttggtgcaggtgtgccttagaaatgccctggaattcctctatatgcttggcctggggctctgctaaagaaattggcctgcactggtgggttgcgggggtgggggtggggggtggataaggggtactgggggccttccggcttagctttttaagggtttttgtattttttttattaaatttttttcatttttttaaagtttaaagtatagttgctgtttccgtgtgtttttaaagggttttattggtaaaatgttcagagaggtaggaaaatgttcctgcgtatcaggaacaggttaccaccagccatacactgggtcggaagcccagttctccaccgtaataggcagaagagtgcctttccctgataacctccctccccatgctggttgggagaatttatgaaataatgtattgttttctttttatatgtttcttattttccaataaaatagtgtggtagca

SEQ ID NO: 40 - DNA, 196935 bp, Homo sapiens
gagggggcggtcgggtggctcagaggagggctctttctttcttctttttttgaatgaaccgtgtgacgttacgcacaggaaaccggtcgggctgtgcagagaatgaagtaagaggacaggcaccacagccccgctcccgcccccttcctcccgcgcccgcccctccgcgccgcctgcccgcccgcccgccgcgctcccgcccgccgctctccgtggccccgccgcgctgccgccgccgccgctgccagcgaaggtgccggggctccgggccctccctgccggcggccgtcagcgctcggagcgggctgcgcggcgggagctccgggaggcggccgtagccagcgccgccgcgcaggaccaggaggaggagaaagggtgcgcagcccggaggcggggtgcgccggtggggtgcagcggaagagggggtccaggggggagaacttcgtagcagtcatcctttttaggaaaagagggaaaaaataaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaagtaagttctctgcacaggaaattggtttaatgtaactttcaatggaaacctttgagattttttacttaaagtgcattcgagtaaatttaatttccaggcagcttaatacattctttttagccgtgttacttgtagtgtgtatgccctgctttcactcagtgtgtacagggaaacgcacctgattttttacttattagtttgttttttctttaacctttcagcatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggtaggtgcacttggtgatgtgagtctgggctgaggccacaggtccgagatgcgggggttggagtgcgggtgggctcctggggcaatgggaggctgtggagccggcgaaataaaatcagagttgttgcttcccggcgtccctacctcctcctctggacaaagcgttcactcccaacctgaccgataacgcctgccatctaaaagtctttaacttgcttgctagtcgtggagatccaaagatctagcgtttgtaatccagtaggatgtggtggtaaatggtaccccttcagtgtttctcaagctgaaggtccaggagtccccaggaccaccgtttcctggcttgagcagcttgttggaaccggagggaggtttcagggactgcttatgaaccagataccaggttgggtcttgacagtctgcatcccaaacaagctcccctgaaacaagcccgttgtacactaaaattggagaacaacccgattagaagaatagactccacagaagaccaagggcatcatcaatcggtaaaattttccaaaagaggaaaaccaatgtaagtctttttccctgaaaaacttagttgtgtttgtaaagagctaagttgacattccaaagtccttggactggaatctccagtgtgtgccatgttcccagtgggcgtgatgaggtgtcctgaggagtatcaggctatggctttgctaccttgtcagtgacagaatttgcatcggctgcattctttgtattctataatttgtgtatggtttaccagtttgctagaatgttagaatcttttgtttttcaccactcagagtggacctaattttgtggtcggctgaaaaaaatttgcatctaggtatctatgtaaagtgtagaagaattgattcttagctgtggattatcttacccttactttagttgaagtgattgatacctgtggctttgaagaacatttgtgagatgatctttttctcgtactgtgctagatagagctttcatcattataccatacaattgtacttttctgagattctttgttggagggggtttagttcctaagagtcaaggattgtaatggagatctatatctcatatctaaaatgatgaatttatgaaaaagtaattcttgtgtgaagttttttttttttttacactttttgttttaatctgaagagttatctttgaaaaacaggatgcaattcagtgcttccttttatagcctcttgggagaatgactaatgtcattattttataggacctaacaggagcaaaaagcctagaaattactgcaagtggattagatgtcaagaagcacaccacatgtttttattacattttacaaagtgtgctcatactaggaggccaaatagagaaaaggccaagaaaagtagatgattgatgtgaacatctgatcttatttgaccaaagttgacaaaatattgatgccactgtttggtgtttaaaagtaagattaactaaaatgccccaatttaaatttctaaaatttaaatcctcttcttgaattgtttgtttgttgagatctcacattatcagatctttagtaattctggaagaatttgctaaagggtgaaaagaatatttttgttaaatatttggttaagtaggtggtttgatttttaatcactataactaaaggggttgggacttccagattcccaaaggatccttttaaaccaaagtaaaactgatttaatagttttactatttcacatttttgtgaaaaattcacacttacaaattttctttctacttgaaataaatccaaggtggtaactggtatctgtctatcaaataagttaataaaaatgtgggaaacagagacacatgtttatgacagaaattaagatacaaccttgatatttgttgctgaatttcagtgtgttaccctctcatgtaactgaagtttctttttaagtaaaggctcacttttttctttttgtgaaacagagttttcatagtagacctatctttgtggtcaacaggtatctgaggttgataaatgtagaggctacattttatgatgccaaaccacaatgacataccatagaacatgataaaaattttttgacaaaactgcttctagtaaaaataaatcatgtagaagcacagatggttgatggtaaaatatgtaatagctttcagaacaatgcatagatggtgactatataggaaaacaaaggaatttagagaaaaaatatatatatataccaggaaatgcactcataggacactttggaataaaagtggtagtgtttgagaatgatgaatgatttgcctatcatttcaaatgtgcattattaatctaaaagtcattttaggcatttggcatacagacagattttcttcacatttacaccaattggggttacatctctaataatatgttgtattttatagtgtaaggtagtcttaatggtaaagcttcagaagagagctagcatattttcttggcatgtgacaataatctgcactgtccccagggctccgtggattagcccatctcctgaatactacactgaatactccaggctttagactgcaagtcatttctttttctttgctgctgctcgtagaaaattggaaccttgtgaggctgaggaaatctgtttgacttttgtgttccataacatggataaatcaggtccttggaatgatcagcctctgatagattgtcccagaagactacaaattaaataaagactaaagaagtaattggctgtagagtggagtgtggatttattcctaggtctgaataaggcattgtgtggcatccagagagaggcaggacagaggaagcagtgagagagaagcaattctagaaaatgtggataccttgctgctcagtgtggcttatagacagtagcacatgcatcccccggagctttgtagagatgctaaagctcagctcccaccccagagctactgagtcagaatatgtggtttgtgtgcacgttaaagttagcgatgctggctaccatccttggttcctggtggcatcttttaggaagagttgctacctgggatggattctgcattgtccccttccagtggccttaaagatctatagtgttacttggaataccgagtatttcccaggtgtccactattgtgatctgactttaggaagacataaattggatgaaggagagatagcaagcaggtagatcaactataagcccagtcttctcatgaatatttttcgtagtagttatatagtttatattggcatcactggtcccattaaaaagtaagatagcttttcttcaattaaaggcaagagaattagctcttttaatagctctgttagttattattttatcccctcataacacagtttaaattctgtaaatgactttagtgaccttgcagcttctttaagacaaagggactcttgcaggcaagggattgagttttgggcaggtgatggagagtgaccctctaaactgggaactgtgacgacattcagcttcatgtcttaggagagagtgagataggagccactagaagaatgagatgattcagacaagagattgtaggagattggctttattctgttgacaagatggtaatccgacttattttttggttttttggtgttggtggtttaggaagacaggaacttctccacacccggtagagttcagctgccttttcattagtcagcaagcagtttttcctttctcaaggcagtccacatccagcaaaacatttgattaactggaaagcaataccattctcatgccagtgtacaaattacatgaaagagcatcatttttctagtgtctgaggattggctgcttatggccaattttggcagcaagacgataggattaaaaatagcttgaagatgatctagtcttaaataatatatttcatgatgaactttccttgggaaagtgcatctttctgcctacaagaatcacatgacccctttcaataatttatgtagtagagaaaaacacactatttctcatagagttttcagtcatgtgctgtggtgtgattgtttctggacattcataaaattttatagttaactgaattctcttttctgttttgttgctatttaacgtccattgaaaacatggctttcttttgcgcattctgttactttcagctgtactttctaataagaatggattgccctttttagcaatctttgattgaactggtacatttcagattacttaaatgtcatcaggccacacagcataccaggtaacagaaagccataaattaaaaataaaaaaaaggcaagcaaaattcttgttgttttttcttatctctgttcccagtcctattgcgctatttggagggatgatacgcccactcatgagcgagtgtgtgggtgctgcatgttaacagtggttcttcccacccaacatacctccgcacccttttctaaggtcactcattgtgtcttagcagtagtttagcaaagcagtatctcagcagaagtgcatttgtgctagaaaacaacactgtctttgtagtgtacaagtagaacgttttctttttcccccagagatatattgtatttgagattcaaaggttctgttcaacctttttaaggtaatctaatatcaccttattcaggtataacagtaacttgtcaatctggtcatcctttctgtcaaccacatgtaggagaccactcagtgaatttactccactgtgaattttctctttcatccctcttggtttggcttaatcaaccttaatgtttgatgtctaagcaggattaatgatgaaaatcatccaaggactgacagttattccacagatgtgattgccagtcttacatgagtcctgccttgggttaggttggaggcacggcaaggagagctttgcttctgccctggataaactcacaggctagtgttgcaggcatcttaataaactcgtagttatcatacagcctgataagcatgatcctagactcagagacttagaggaaaaaagcaaataactataagttattttgcatgtacttcagccttggtctaagaacgttatttctgaccatatggctgttcatgtgtgcattaggcctaatttaaacagggccaaaatgtagatactttaaaaaatactgtgtaacgtagacatatgcttaagagaactgaaaggcagggggagttcccttgttaaatattaacccactaagcactatttatgcatactaagaagacttaataaacaccagtctacaatttctaaagcatttcattaattctttttaagtaaaagacaatcaaggctccgattagactgactggaacagggtaatttgaagaactatctttcttaaataactcttgtatgccaaaaaatacaagtaggttttgaaccagagcgggggctcttcctttgagcaggggaaaaaaaagcttctgttttgttttggtttgaggttatattactgttctatttatcaagacacttctacgatgctagttacagaaattcacagtccattgtaacactggcatttgccttcggacttttttgggcttgtggtctgttcgtttaaatggagactgtaaaactttcaaaatgccaacaaagctgttttcacttaaaaacatatttttatagattgtcacttgttgttcttatatatgcccaattctgtatatgctatagcactatttctctgccctccatttgccagacaaaagatacacccatctgtccttcagtgtgaataaggattgaatgattattcctctctcttccaagccatgggactttctcataggtgccaccacccctgtgaccatcccctacctgccttatcattccaccggtgagggacctctcaggtgtagctccttgttaacttccaattagtgatgggtaggatttacctgaagaaaaccgtaatgcgcttagatactagcaaaagggagcagaagtggggagtctaatcaaagtgagaggataaccctcaccccaaacttgctgcaggcagctgggcaggtcaaaattctgtgaccagacactatccttttcctctagtgattataaactttaacctgtgcagagaaaagatagtatctgctggcaaaatttgtacttactttgattcctctagtgcaagattatagtggggttatacctgagacttcaataaatgtttgactaactaaactaaaatagcttagggtaaggactacttccccaaacgcccttttaaacatgtgagaaagggaatctccctgacatactggtatggccatttgtagcaatatactgagagtgacttgggtgattttctggggcgatcaaccacattccatgagcaggttaactgtggaagacacctgcccttgagcatcgcgtttgggccacatgcgtcaatggggaaatttgtgtttccattctgcttcttgttttgccttcacaacttcagggatagaagcgtattccatttttagttaataatcagctctctggggcttccatgtaatgagtcagaaactgatgactgactccactctgctcattatcatgtctcccaaaaacaacccgagaacccactgtgtcaagtgaagctttaatttttcaggggaggttttctccattgagaccaatacatcttttcttgtgacagatccagttaccatatttccttatttttaactgtcgaaaagacagttaagctgcaacagagtatggtgagtttaccaattttaatacttgaagcaccaaacaaaggatcagtgttgcaggctgtctcttcttgactttttccagctctccttagcagataaccaggatgatattttttctgctttacaacatgatgaatgctatatctctatattaactctgaaattgaattgcagccaaatattcctctcagctgcattagaattttctaaaagaacatgagacacataaacttagtcttcttagttcaatgctatatctcagatatattgatatctgatttacaattaaaataggaataaaattaagtacaaattatatcatcagctttaaatattgatttatcttcttgaaaaaaaaaaagcgagtccataaaggatggcagcattggcatttctggatgtaaaatttcagggctatctcctagccatatcctttatggattcctgccagcatctttaaaaacacacacactgaagacacacagagaggttttgaggtattttataacaaaattataagaacagggagacaaagccacttactaaacattaaagtgatagtataagaagaaaatgatttgaagaagtcctaattgagggaaatgagcaattgtccacaaaacttaaccctgggttcccaggaaccggggtagtgatggtcatggagaggggttttagaatctggttatttaggaaaacatgcacactaacttgtttcattgaaaaaaacatttattgaggccctacaccatgcaaagctctatgctaggtgttttagttaagcgaaaaaatgtctaagataacttttgccttcaaggaacttaccaatcagtaggagaccaagacaaggatacaaatcactgtaatcctggacaatgtgtagtagacagagaggcccaacccagctacagtggtatctgaagagtttcatgccggagataatgttgagacaagttttagagaacaggcaggcgatacggggagagggtctttcaggtagtggaaactggaggcgtcaaagcaggcatgaatgcgggaggtgtgtttggggaattgtggagagtctgatttgactggggcatggagaactctcctgagataaatccatagttttgagaacttaccactgcatactaagttgtgaaacttgtatagacagccctccctatctttgggttccacatccatggattcaaccaactttggatcaaaaatatatggggtagggcaggcacagtggcttaggcctgtaatcccagcactgtgggagctcaaggtgggtggatcacttgaagtcaggagttcaagtccagcctggccaacatggtgaaaccctttctctactaaaaatagaaaaattagccaggtgtggtggtgggcgcctgtaatcccagctactcgggaggctgaggcaggagaattgcttgaacccaggaggcggaggttgcagtgagccgagatcgtgtcactgcactccagcctaggggacagagcgagactctgtctcaaaaaataaataaataaacaaacaaataaataaaataaagtatataggaggatgtgcatatgcaagtactactcatttaatatcagggacttgagcatcttcagattttggtatccactgggggttcctagagccaatcccctgaggttactgaaggatggctgcgtttaactgtaccagggatgttgaaaggatgttgcaaaggttctcagacaaggcaggatgtgtgcgtgggaggaagattgacagtgactgagcctggacgggggagaccaggtatgaggtctgaagcacctggaacagaaaggacaggacagatgtgggcacactgcacgtgtagaatcaaaggactgacagcaggtcgaatgtgaggaatgagggagggaaagaatcaggactcaagtgccatcctggctgcctcaaaaaatgatactgtcttccagagggaaaggaaagataacaacagttactgctttgtggcgtacatgtgatgaatttcattttggacattccagtaggatatccaagtggaaatgcccagtaagccttagacataaggatctggatctcaagagaaaaattgaggttgaaccataatatgtctttcccctcgaatcatgtaggtttctcttttgccttctttcattgccctaagtggtcctaaatgctactgctgatgctgtcttagtttgcgactgttgtttgcaccccaccttttcccaaaggtaatctgtagacttgcatggattgggttaaggtggttaacctgcagctttgctgttcaaagcttggcttcccactaccagtttgccaacttaatgagtacttcaacttgagtcaaattagtattgttccaaatatcctaatagtatcctctatgtgtgactctaggtcttacaaaatcaaggtgtcctttctcattgagacttccttattaataaaatatttcttctattaaattcaacctggcaccaagcatagtaggtaataggcacacacaatgactgtttattgaatgaatgaataaaatgattatgttagggcattctgagcaattcatcctaagcagctaattttctcctacttcttttattatagtgtgtgtttgtgtgtgtgtgtgtgtgtgtctgaaatgtcccatcctacaggttcattaatatttaatagaaatgaaagaagaaaaatacctattaagtgttttgatttcatccttttcattgaattgaaaaagtatatcatttattcctgaagagaaatctagattttgctctatattaaacatttgacatttattggtccttaatgctaatatagataccagcctgctggttgtcacattctatctgtttatacgaaggttgtagacacacagtgtatgtacatatgcctagttgctctcattccttttgtttcacatctcaagcctaacccagactgaaaaggttttgaaggctgagattattcatcaccccatcattatagaaagcagggctggcccaaggttctcacagtgggagcaaggtggattttaactctgatcagtgttgtagctcaaatataaaaagaactgcagcacaaaagtcacaaggataaatgatcccctcgttcttctcccataaaaataagcagccaattgaaggtggaagtcagtacagtgcggcattcccagaggcgacagaacctaagattccatttctaaagacactgctcaacaagaagaccacctgggatgtcttacataaaaccattggcctggcagcttttggctgagttctctattctggttcaagccagcatcacagcctatctgtggttttaacaactgatggaatttgtattttgagaaccctcatccgttagcatgaagcaaactcaaagcattgttgctcatcagttgtcatctgtttgagaaagattttgatttgtttacttgtagtgaagcttgaccatacttctccaggggctttttaaaaagatgaatgtgtcagcttgtagatttgtccccatgaatgaaaccacaagcaaattctcttctctcttccagcctcccttcctccctcttgtttcttcagtggccatctgtgcattatgttcccattgccaggccctcttcaagcagcttatctatgagtgaattcagaaacttcaaattataaaggacacccagataattggcctgttctccaaagtatctgtcccctgtgctgctgccagattccttcttaatgaatacatccagtgacagtgggattcttgagcttgtccgtatctgtgagaaaatgagctctcctgctttgtaacagcttgtggctcagggaaaaaaatgacagccattgcacaagtttcctttgaatgtagttttctttcccataaatgatactttgagaatacagttaaggggttattagttttctatttcatgcttggcctgtgtgtgagaataacacaagctgtcactgcaaatcagtagctaaaaatgctttgtctggttaatgtgaacatttaatatttggctcaattaaaaattaaccgatgaaagtacatgtcattggaatttgaaaataccttttgtacggaatacttaaagggcatcacccatgactaaaccagtgcttttaaaatatggagaatatggggaaatttaatatgagttgggatacttgactcttttttaaaacctctctacctgtttggcacaacagggtattgataaagagtgggctcattgttatggcaaaggattcacttgcatctctgtgtttttaagtgggtaattgtttttttgcactcagtcacatgattaaagcagacagaacaagagatcagttattcatttataccatacttttaaaaaaatattgagccaggccctggggaagtgggaagtgagagccagagcggcgtggctgatagtctagggcagtgctatccaatcttttggcttccctgggccacattggaagaagaagaattgtcttgggccacacgtaaaatacgctaacacgaatgatagctgatgagctaaaaaaaaaaaaaaagcacaaaaaaacctcataatattttaagaaagtttacaaatgtgtgttgggctgtattcaaagcctgccatggattggacaagcttggtctgggggagtgaagaccattcaacatcagctgcaggagagcatgtttaaagctatgagaagagatgcagcaatagtggtggcatttattggagtcaaggaagtcttcccaggaaggggactgaagcctgaaggatgagcaggaatcaatgtagtgaagtgggtgggaggaaccaagtgtggccccaggcagaacttcaggaacaaaggccagaggcaagcggccacatggtggactgcaggagctgaggagttcagcctggctggagtggagagtgcaagtgggtgggtcagaaagatgatgctagaggtggcccaccctggaagagtttgtttcagatacgtcaccctgactccactccagaccgttaatgagacgggggagaaatcagtgaccagatagaaggctctttcagcaaacgggcaagagatcaagtgcctgacctagaggaatggtagtgggaacggcaagaaattgctagctttgcacaatgattaggactagagtggagagattttttggaagaggtaatgattgactgaatgctttagaacatggctcagttcttcctcagctttgctggtctttctgtacaacttggaaagaatgtggtcattgttctggttatatataaatgcttttttgtgttttttgtttgtttgtttatttgtttgtttttggagataaggtcttgctctgttgcccaggctggagtgcagtggcaccatatcggttcactgctgcctcgaactccggggctcaagtgatcctcccacctcagtctcctgagtagctgggactacaggtgcatgccaccacacctagataatgtctgtcttatctttttttgcgacaggatctcactttgttgcccaggctggtcacaaactcctggcttcaagcaatcctcctgcctccgcctcccaaagtactgggattacaggcatgggtcacctcacctgaccttatacaaatatatattttttcttatttcacttttaaaaaattgtctggttaaaaactatttttgttagaattcaccgtgtgataaatctttattaactatcagttaataaaagtatatttgaggaaagaattcaattatgaaaggcagttttcatagaatttttttccgggtgaaaaaaatgacagtggtttcttgcctttacgtaggattttaaagtttctaaaaaaaaattccatatctgttggcccatttgatcttcacaacaaccctaagcaaggcagatattgtattccaacttctccctactttcctccccacacacactgttagttatttgtttatgcccatgtaaagaagaaagttcgcccaacaaaggtgtgtacgagccaataagcacaggaagagctgatattcattccctgggttgggaatcccgtagatatttctttatcctgtgctgcttctctggatatgtgttcataaagacacaagattgcttagtagagactgaaatatattgcattttgaaaactagtatactctactgctttctgtgtcaaaaatgttcagggaaattggaatgcagtcttttgtttctggttactttcccttcttcgattcagcctttgcagcgtttctcatgcttgcagcagagggggatctagctgcttccatttggtgcctaccatcagctcaagaccctgtgaggatgcgcttatgagccaggcgggcttggacatgagctgaagggacagtagtaggattgacgtgcgaggtctctaacacttgaaggccctgtaaaacagcccctttcaacaggggccaattggaattagatgaacatgtgtgactgtttttgcttgttgacacctgactagcaacggtgttatgttagcatgctgtttgctgcctttatttctttgaattcctcagagtccttatttattattttcaaaggttgtaattagctttaatcggaagtgcccgtaagtgtagtcctgtaaatgttgctcttccatctttcttttttcttttcccaagaaaatgccgcattggaccatcaggaaaaataactaatgggtactaggcttgatacgtgggtggatgaaataatctgtataacaacatccaacaagtttacctatgtgacaaacctgtacatgtgcccctgaacttaaaagtttaaaaaatttaaaaaggatgtgaaacaaaaaaattaaaagaacaaacactaataaatatgaagaagtccttcagagtctttaaatttgctcatagagcattgactgagacactatctcctttagtaactaaataaaattaaaaaaataacactgggctcctctttttaggtgaccaaaaatatttggtacatgttttttgaatgttgaaaatggtggagccttcatcagtagggtttccgcagtagtaaagggcatgttactgcaagttcattcaatcaacaaatatttataaatatttgtttactgtaaagagcctactctgggccaatcattgttctaggggctggagctataacagaaaacatgacaggttaagaactctcccatctcttgtgaatcccacattgtgaggaagtcagaaaagtaaacaacttaaaaattaacaatataacataagggccacaaagtaatgaaaacagggcaatgcagtgcaagggtgctgatgggacaatattaacttcttccttggtctttgagatttttcaagcagtactacaagtttacacagaggagatttaatgggtttttcttcattaatagttgaaaacagtgttgtaccttaaaaataataaatgtattagtataatatagcccttacatcagtttaaaatgagttaccatgaacaatatgaacttaaagagacttttactatttttggctaaaatgtttagcgcaatcttttccttacctactcatccttctcatttccccatttccatttatgacaacattggtcattggcctcagtcaccgaaagtcaggaggaaggaaggaaatgaatatttattgaaccccaatatgtgccagaccctggatttaacacttttagggataggagattatttaacctcaataacctctccctgagggcaggaagtggatttatagatgcggaaacagaggttctgcaaagtcaattgactttgcctggtaagaggcaaaaccagcatcctttatttaggcaatccaagtgatgttcatgtcctctggaacttaaatttttaaaacaaaaatttaaacagaaacatattacaaaagaacaactttatgcatgtgaccttttgggttctttaggaagccagttagtcatctttattttaataactagaaggtgaaatctttcctacaacatgtaattttaagttctctcatagttaaaaaataaatgaaacaactttttttttctgtctcccttttgactcctagagtctgtttaaatagcctttgaaaaataagtactaatcactggttcctaccaagaccagacacctgattcagaagctcttacaggggtcagagtgtgcgttggaaaaacaaacccacagtgccttcctggttccagagaaatgatctcactgtcaaattgtaacctgcctaataccttaataaaaaggtggggaaagtctgcggttttacctctggtatgatccttttcccttcactctttttattttaggcatgaccttagtgttttttttcttctagagtccagaggtggaatgacatgtcactcaggtttacaagatgaggatgtatctgtttttatattcagctgtacattttattctacttaaaaacaaacccaccttcagcaaccagggcgtatcaagggagagttatttccatccccctcagtttaatttggatacatttggcccagaacagcacagtgtttccataataacatttgaacaggatgcccttgtgttatttgcagggctaagggagtttcagcatgggccaggaaactactttcttaaaagaaacttaaacgcgaaattctgacaagataggaaactcttactgcatccttactaaacctctttttcccccctactttctcatttatttatatatctcttgtgttatgaaacatatataggttgaatatttaactcactctgaattcatgtgcagaataagtcactcttcagaaggacaaaaataatgttttaagtggtttgtttaataaagcacatattaaaaaatttcaattcaacatcttccctgggcacaacatgttatgactttttagagtagagcttcgtggtatttcataaggaagccaaaaaggaagggaaattattattcgggcagagggacaatagtgacctttcattaagcaagacagagttcaccatcaggctccccaaaccccaggctctgtgttagttgaactgaacaagccaccaactatttcctctctctctttctctctttctctctcttttttttttttttgagaaggagttttgctcttgttgcccaggctggagtgcagtggtgcagtcccggctcactgcaacctcagcctcccgagtagctgggattacaggcgcctgccagcacgcctagctcatttttttgtattttttttagtagagactggttttcatcatgttggccaggctggtctcgaactcctgacctcagatgatccacctgcctcggcctccctcccaaagtgctgggattacaggcgtgagccaccacacctggcctcctctcttttatagaccagactactttaaaaatattcgtccaatattacctaaaatatttcatttataagacataacccaacattgtaatatttaaaagactgcattatgtagtttttacatatccttaagatcctaatgaattcagataatcagtatttttgttcttttaacagctttacatgtgacctcttagttctagagtttgatctcaggagaagggaagagtagatttggattctgtgccgtggacaggcgcactggtttcccgtgtgaaaaggacaaagccccgccccttctggagctcagttctctttgggattattcataatgttctccaagaagctcggagtgcctgtttgtcgccagtactgtaatttgtgagtaaaagatctttatgattgcaaaatacattagcgccttcggagatcattgtttcttgatgacggtgtgaatcacaactaggaactaggaagtcatttcagccccttctgtgcagagggatgtcatgaagtacatatgctaaagttcatacccattgctcataagagctcagccaaccttctcaaccagttcatgtaaaaatatatctgtataaatatgcatacgtatgtatgtatgtggtgtgtgtgtgagttaagatatacataaaatttacgttttccaccaattttaaatgtatagttcagtggctttcagcacatttactttgttacataaaccattattatgtaagccattactgacatctgtttccagaacttgttcatcattccaaatggaaactctacccattaaactataactccctgtttctttttctccccagtcctaggtagccactattctattttctgtctctataaatttgactcttcgaggaagaatttgattcttcccataagtggaatcagacaatatttgtccttttgtgtctagcttgttttatctaacatattttcagagttcacccatgtcatggcatgcatcagaatttcattcctttttaaggctgaataatattccataccatttgcttttttaaaagtccattttctcaaaaaattggttgtcatttccactccccacccagccaatagaaacagcaaatatattaaattagaattgacctgacagaggaggtaatggaggcctgtaaattattcaaagaattattttagagtctgacagcaaggaagaagacaaaaatgctcttaaaaccagctcaggagtctctgaggctcttctgcgtggggcaggcagtcacaaagatctctacggctcctggagttctcgctggatcgtagcacaggacaatcttagtgattcctaatgatgccactgagtcatcaagacagagttattttctgtaggaagagtcaaagagttcagggaaagtgagtagtaagttacagaaatatctccattccaaatggttaaaattttttaaaagtttaggcttcagtcatctgaaaaatttacttgtgtgaaatgattcagtccagactgtagtgaaagagaggaatcccagcaatatcaaagtaaaatacacacacacacacacacacacacacagagagagagagagaaggagcacaagatctctttcttttttgtttttttctctttttttttgaacaaactcttacatatccttcaagcccaggccaaatggcaccttctctgtgaatgtgtgtgtgttaaataggcagagagaccttcaggggcgtttgctgacttctttcattctttttcatctcctacctccctttctagagtagagaattagtaggaacttgactcaagtggacggggatgtaatttctagggggagtttttgctgtcttactgcatctaaattattctgtctgtgcataaattaagttgtacacatatttagaagagccacctcccccactgcaggatgcatagagtggtttttgtgaggagctgctttgcagcctcaactctgcctcctgacttcattttgaaaccactgtacaataaaacgtggtcatttgtttgttccacattctttgtgcctactgggtttctggacatgatctctggccttgggggggacagtctcctggggaaacagacacacaaacagatctattacagtccagtgagttttttcctgggaaagttaaggatggtttcacagagaaggtgccgtttggcctgggcttgaaggatacataagagtttgttcaaaaaaaaaaagaaaaagaaaaaaaaaaagcaagagatcttgctctctggagaatgtgaaagggtaccatatgcaaataagcagagtaattgaagggcctgccaagcttgggaatggcaaaaaggccagagtgaccagaagagaggcagttggggatggaatggaaggggatgaagcgggaagatagtggaggctcgctctccaaggctctatgtgccccactaaggagtttgattagacctttcctgcagtggaatgccagtaaaaggtttctagcaggatactaagtgacatggctggatttttttgttgatgaaaatactgctggtagcagtgtgttggtggcactgagggcagcaaggaggccagatgggaaggtggggtcaggtgcccaagtgaaggtgctgggcagctgccccaaggcatgggcagtaggaactcccaggatgggactacctgaaaaggtgttctaaggtagaatcaacaagattgtgcacagttgatcatcgctgaacactcagtgcttagcgcaaggcaagcacataatagatgctcagtaatattgactaaatgaatgaatgcacaggcagctgggtacacatgacaagcagtacaagcaagtgttaaagtgacaccccagctatactcacaacagtgataaagcagaggttcacatggcctgtactttgcccaactctttctaaacgttctatcactattcgtgtatttctttcttacaacagtactgggaggtggtggtgtttttatccttgtcttgcagatgagaacactgaggcttgcagagggggacccattacagctgtttgggtggctgggctggaatttgaacccaggcggttttggagtacttggagcccttaattctgttgctctgctgccgcccagcttttgagccttccaggaagctgctgctttcaaggccccagaagtgatgactcggggcaaacctaagtggtggcaggatgcagagaagcctgtttaggaaaccatttatctcacgtagacatgccatctgagatgaccttagtagaaataacaatggcaatgataacagctccgcagccttttccctggcataagaaactagttttgtaatgaaaatggaatttctctggggaatagtcctagaaagagataggtagttgagataaaaataacaaaatataaaatagcattgcattgttttctgtgtatttttccttccacctttgtccttctctgttgtgtaatttaccttgttcccttggccatgggtaggttgggcatcactgtgatttgacttttgtcctttgtcccaaagaaagggatgagtgtgtgcatttagaggtagctatttgcaccttgcctggagcttgccatcaacatagctagctaaaaggaggagaggcccttgagggtaaaccttgctttaggagtcgaagcccttggctttctggaatgaagggtggtgagtttggtttcccagatggcccatgggccagaatctgagctccttggcattcaggtgtgtgtgccgttctggatcattacaaccacgactgagctgtgttttcaagccataggtcagagtcgtgtaaaataaactcttgtcataacaaaggatgcggcagccagattgcagctcggagttccttcactcatttaccccagaggacactgattttcatgtcagcatagggaagagattccatttgtctgccgattctaattgggggtctgtcttgctcgaccaccctggtaaatggtgataaatactggtggccatagcagcacagagagagagtgccggcctggaaacccagccaagctctcttggctccaattttatgcaaatttgcctaatagaatgcaaatgatttcacaggaatacggatcccagggacacgtgctcatctgttttcagcagtgttcctgggcttttagaagcagccacttgagaggccaggcaagtccacagagaggcaggttaaaggtggcttgcgaaggaatggctcaccccatcagccgatgccacgcctggaatttcattatgagcagcggctttccctttggcagtctgcgagccaagacttctgtgttttgggaacaggaaaaggtcaacacagactaatgctttttcaaaaagtcctttattcttcctcttattctacagattttctgcgatcacagtatatatccaaacatttactcatcctacacatcttgattgggcatttagtcactaaaaggcactgtgctaggcactgagaaaaggctgctctgtgccaccaaggtgtgacaccataacattgtgtctaaaatctactcctgccctctccagtgccgtggctgtggctaccaggctcacgtaatgtggccaatctgaattgagatgcgattggagtgtaaaatacacaccaggtttactggatttcaaagatgtagtatgaataaatgaatgcaaaatattttatcaataatttttataagaattttgtgttgaagtgatagtattttggatgtattagtttaataaaatatactaaacgtgaccactaaaaatttaaaattacatatgtggttcccattatatttctttctttcttttttttttgagacagagtttcgctgtgtcgcccaggctggagtgcagtggcgtgatcttggctcactgcaacctccgcctccagggttcatgccattctcctgcctcagcctcccaagcagctgggactacaggcgcccgccaccatccccagctaaattttttgtatttttagtagagacagggtttcaccgtgttaaccaagatggtctcaatctcctgaactcgtggtccgcccgcctcggcctcccaaagtgctgggattacaggcgtgagccaccgtgcggggccggttcccattatatttctattggacagcactggtctagactgctaaccatttattgcacaatgtggtcacctttttattcccatagttggatattactatataggaggatagaaagacctttccttttttcttcaatgagctacagttgtgtagccctttttaaagttcattcatattcatgttcttgtggctcccattgtcagtctgctgagctgggcagggaaggcctcaccatacttttacaggtgagcatactgaagtgtaagaggtcactgttgccagcctgccctaagagttaagccaagaataaaacttcagtagtttctgggtggacgtggtggctcatgcctgtaatccccgcactgtgggagaccgaggctggaggatcacttgagcccaggtgttcaagactagcttgagcaacttagcaaaaccctgcctctacaaaacacaaaacaattaagccaatcatggtggcgtgtgcctgtagtttcagctgcttgggaggctgagatgggaggatcccttgaggctgagatgggaggttgaggctgcagtgagccatgattgtgccactccactccagcctggatgacagagtgagaccttgtctcaaaaaaaaggacttcagtagtttctaactcttgccaggctggaccattacagctgggttgggaaggttggaaatagaactttcgacttctattctagtgtctattaaaaatacactaaaatttatgcatggaaatatttacttttatttctgtaccaaagatgatagaacacagcccacttagaagtatttctgtgtgcatgtgtatgtaaatacacacaaacatgctctgcagctggctaataaaacacagtaatcaaagcctatagtggatattcagtgtaaaggtaagacttgctgaattttgaggcccattggggaagggcagggtcagggtgagacaagcatgtggtcacaaccagggggcgttttcttctgttgggagtcaactactgttagggaaaattcctggcagcgtggagcaaggttggtggatcccacctgtcagaaaatcctgagactgggtttagtccttgagggatggaaggacaaggcaggtaccctggaccaaagaggcaagggatccaacccaggtagtcacccagcattggggatggcttaggaaaaaggttggggaggtgcagttctaaggaagaagagagaattgatcaagaagaggaggtggatatgggtgagagctgtgtagttgttgaggacatttagggcaacgggccttgggttgtattcttctgacccgccaggcacttgctgtttgggcatgtcatatactcttctgagctttcatttcttcatctgcaaatggggaagttgagttacagggtccctcactaacattttgtgattctatgagtttcgaaggccagagaatcagcaagaattgtattaataagctatcaatgatggtataaaggttttgcttctcactgctgctctttctgctgtctgatgtgctgggggcactgaggtctatggcaaatgagatcattggcctggaccattcacttggcccttgacagacacaagttgggtctaggatttctttgcaactatagccaatacatacatattgtagtataatatctaaaaacatttatacctacttgtctttcttggttctctctgttctccttgtccctacactttctatgaattataataataataataattattactattattatctttttttgagatggagtctcgctctgtctcccaggctggaatgcagtggcacaatctcggctcactgcaacctctgcctcccaggttcaagcagttctctgccccagcctcctgagtagctgggactataggcactcgccaccatgcctggctaatttttttttttttttttggtattttcagtagagatgggggtttcaccgtcttggccaggctggtcttgacctcgtgatccacccaccttggcctcccaaagttctgggattacaggtgtaagccaccgaactcagccaaattataattatttcttatctcctatcttcagagtctagtgttacacagatagtaattctccaacattgctcatatgatttagtaaatcactgcatgttctcggtttagaaggattttccctgtcttataccttctatgaattaaaaagcttttggaccatggatgaatgacataagaatttaactacttttttttttcttttcttttgaggcggattctcactctgtcgcccaggctggagtgcagtggtgtgatcttggctcactgcaacctcagcctcccgggttcaagtgattctcctgcctcagcctcctgagtagctggaactacaggtgtgtgccaccacacccagctaattttttgtatttttagtagagacagggtttcaccatgttggtcaggctagtcttgaattcctgaccgcaaatgatctaccggcctcggcctcccaaagtgcagggattacaggtgtgagccaccctgcccagcctactttttctttttaaagaatttattttaattgggtttcgtaaatgcagggatacaaaagctattggatcttgagatagctttgtattttgtagagaatcatcccaggagcacattccctcactgagggttccagccacctcttccgcctcattatactttgcttagcaccgagaagtctggcatcgtttctgttggaatgaaaagattggcagagctgccctggacaacagcactgcaaaacactgtggcagaaggtttggtctacataccaaggcagccaaagtattaattgcattctctgtgatcacaaaataaggcgctgaattattctcttcatgttttaagaatgacaggcttttgctctgccagctccaagcatagtgcatcacatggaaaggagatgctagatttgcaaaaaaaaaaagagaaaaaaagcacaggagtgaagatctctggtagccagctgcttcctaaaaaagatttaaagctgaactgttgcatgagaggtacctataaaagatcaggagccgggtgaggaagtgtttccataaatttacatactctgttaaaacatgttctattttggaatcttactttagattttgaaatgggacttttcacgttgctggctatactttgatcccattttcctttgttttggtgtatttactggagaaaactggttatgatatttctatatgtacttgtctccccccagccccagaacaagcaccatatgtgagtattccagatatccaaggtcctctggacaccccagtctcttccacaaagctgcctcctcagagcctgctgtcccgtcttctaggaatgtacccatttgaaaacccacactcacactaccacaacacatacactgtttcttgctggtcgttcctttaatctcagtggaagatatctcatagagaactgttggtgattgcttaacttggttgggaggaaaatagatcaagcaggtgacaacctgcatattggggattttcctatgctgaaaattgttattctgttgcagcactccaccctcccttcacagccccaaaaaagagaagtacgagtgctgctgatgttcagggtttgaatatgttttggtttaagatgttcagtggaattagagagaatttcatcctgggcagtgcagtcaggctggaggagtattttggtttcatattactaaaccttgttttcccatcccagctgcttgtgtgctatcttggggccactgagaacctggctgggctctgcggggtgggagtgttgtcccggggctgagtccagccaggggtgaggtcgtcttggtgcacatcttgcacgttgcatgaagctcagagcccagcttggctcttgtgaacttcccctgtggggacacaccctccaaccaaagtgagggtccagcggccaccaggttgtgacatgagagccgtcgctattattactcatcacctgcagcagcaggaagggtgcccagaccacagaaatcttctgtctctgggcccgtgcctactgcagttggcagagagctcctgagctccttccctaatgcgtggtgggagagcgctttcttcagcactttcttcacagggtttcctgcagtgggagtcttcctgatgctctttacccccatacttatttcactcccagaatcaaggagaactgttaagccattcctcagtacgatgtgtcatggctgaagaaccattcattcaagacattggtgaagagggttctttcattgcctttcttcaacgacggtttatttgctgtccatttgctgagcacctgggtggtgccaacatgaacccatttccttctgtgcgcaagccccccctttctattaccagagtgcagatcccagctagcatggtacgtgtgagtgcgctgtataaagtctggaaccacaattagaaaggaaagcctttctaaaggtattttgtcttgatattcattaacctattagattgccattctttcatatctaagatgatcataacatgtctcatccaagctgagacacttgttattaatcattattctgggacaatagggtaggccaggatggtcccaggcaagctgatgtctagagtaataaccctgcacatatgaatcttttgaaggattgggcatgatttttttttttttttttttttgcactggggttggctggggctaggagtttgtgatgaatccttccagtatttttctgaaaaccagtgaactattttgtaggtttctgtgtcgttagaaacatgcaaacctatccactaaaaccactccagttgatctattaagtcattcgttaggtcttacctggactctcttcactgtcactatcatgatctgtccacatcactggccctttctcctatcacctagctctcctgtgagcccagcactgatataaagtggtttctagtcttcttggactctcaatttaacttgcttcccatgggaatcttctaactgtttccccaaaccaccttgtagacattcatttctttgtttaggattctaagaataggaaagagagacataagctagattccattcctgtttcagtaagattatctttccaacacaagaaaggaatacatctaaaaaattctttcagcattttttcccgctttattgagaaaaaaaaaaaaagaaatactcatgagtactccagggcctcggttgatagtgtgacaaaaatagttccaactaaactaagtaactcaaggctatttgctttatctttgtactctttcatgtgttcccgagtcttttacagattgggatggtacactttggtttaaattgcaaactcttgtatttaacttcctctgaatgattcaggacggggctgtggacctgttgacacttgatgagtattggtttctagtgcaaatgatgacctgttgaagggcatcaggcatatctgaaggtagctgtccaactaggtcacgttcccatcaacactgtattgtgaatctttggtaagaagagtgataactttttgcaaaatgtagtttttaaaaataaccgtgaacttcagtgtccccagtcaaaataataattcatttggggaacaatttagagattctttcgacaaatacagagaaatggaagccaatcatatgcgcctcaagcatttgatattggaagaaaatcagcatctactaagtaactcttgtgaaaaccttatccattttttgcttttttgcacttttcaatctgcagcataaattaggccacaggaaaaggatggcgtaccttcaaagagccagttgggttggctgtgttctttctattcgtggaaaacagctgtgggtgccgggtgttgaagtcaggcttttgttccatgctaaggtaggaaggtttgttcttgagacctatcactcttctgtggaggaggagttcacagatggtgagccgctttatcaccatctcggaggcttttgaaatatgttgataatgacctgggaaagagggccgagtgggatgagggtgggagtaggaaagaaacattcggcccacacagtgttcatatcttctcttgtttttgtatctgtggcaactgcagattaaatgaattaggttattcttttccattgccttctaccaaatagaagtacttatttaagccttgcagatttttttcctgctgagtgaagcctgaactgagcccatgaaaggtgatctctccaaagcaagggctcctgtttccttccttccatcctgctatctcattcaagtgaaattcctgccatggcatttatcctgagctttgtcacacaggattactgtgatggtccttactatgaatggagtgttaaggtgttttctttagctcgagataaaaaccagttttaggaatgaattctcttttgctgtgaaaaacatgttctaagggaacaaacctcgcctcatttccatttttacattgagcaaatggttgggaagttcctttaatactgtctgtcttgactcattgtctcactttttttttcctgattctcttgtgcgggacctttttcatccccacagcttccgtatcgtctgtatgcagctgattctcaaatgggtatttctgcaaattccagttctgcttatatactatttcctgatgaccctttctatctggacttcctgttggcagttcaaattaaacacataatcaaaatatttaatccaagactaaactcatcgtcatccctccaaaaccttccttggactcaacagtttctcttcctgctctcatcactattccgatcacccaggctcaaaacctagggtgcattcttccagcttctgctcaggtttttgagcccagcatccttcactgccctccattcctccctcactggtcttgctgccaccaccttcttaactcttccctaggggaattcattcacctgctccagtttctccgcactccagtttatcttatactttgtgatgatttaattaaaattcttccctgattgtttttcttcttgaggtggagtctcgctctgtcacccagctggagtacagtgggaccatcttggctcactgcaacctccgcctcccaggctcaagtgattctcctgcctcagcctttcaagtagctaggattacaggcatgcaccaccatgcctggctaatttttgtatttttagtagaggcggggtttcaccatgttggccaggctggtcttgaactcctgacctcaagtgatccacctgccttggcctcctcgagggctggggttataggcatgagccacccttttttttattttaaggctcctcttttcctaggtaagtcttcattttcctttatccagctgttcaaattcctctctccatctttcactgcaacctatgtgacattttcttcatcattccctgctactccttagcaagattgctatgctctgaacccgccctgccttctctgttctggggatctttttcctgctgtttttacatcccagagtattctgttcccatcagaattctccatcccttaaggcccagatctgatctcaccttcaggatgacagtatccctgttgggagtgaccccgctgatttctaaatctttaccaccttttcagcctttttctttttttttgtgccatttttccaggccttgtcacatgctctttgatattactttgatatacaaatgtttgctatacttttccttcttcctcttccaggttataaacatgttgaggcccggggctgttttctaagttgttattttaggcttgtgtatatccaccaccatgccttaaaaaaaggcctcacattagtaagagctcagtaacatttgctgaatggatgaatgaagtatggtggctttgctatctcttactttacttgttcacttctctcctagcttcattcattcattcattcaacaattacatattgagagcctattatgtgccaggcactgtgctacgcatgtaggtttatcagcaagcaaaacaagatccctgcctaaatgtgccagcattctagattcttccttagactcaccatctttgcattcactttactcagctcttaaagaaacagtagacagttattgtaaatactattagctttatatttatgttgttcttctgtgattaaactttgctgccaagaacattatgctttcttggtagtttgcaacttgagtttctgattcttaaaattggttgcatatcccaatggctgtgatggtgttgaaaactctacttcttttctccccttgactgctgaaccaaatcattttccaagttgctctgaaatatggacaaaagactccttgatttcagccctatgtgcagcatggaaactttcactaggctgtgcctactgactaatagcaagtcaatgcccatcttcccttggttgcttgctaaatattctaaaacgaaaacaaaacagcagtgaattatagcctagcatcagtaagaatggaaaacaactgcttttcaaagcttgatttgtattgtttttaataaggaaggaaaagctttgttatataaacacatgaaaatatggtagtgttcgtggcaagtatgttaatggataatgtgcctaaaatctttgctgggtcagtgtcattccctctttgtgatgctgaaggaaagtcacaaaacaaaaacaactcagaagaagctaatgtgtcatcttcatgtagggatctgtattcaaagttctttttcattgtagctgtaatgaaacagtatttgtggaaagatattgcactcaatgccaaaacccaacaattttgttttcaaattcctaaaaactaaaaaaagaaatcttggtgacataaatgttccaaaatcaaaatgtccaaaatgaactcatcaacttcctcctctcgcctgctcatctatgtctgttctgtctgcttaatgatatcactgtccacccagacagagccccaaactcttaaatcattttcaacttggttttctcatctgtgagatagagctttcctggatcatctcttaagattctttccagccctgaaagtctgcatatctgagttcttcactcatactccccacatatctgaatcctgcttctaaaagtctctcttccctagatctctggtttttaggtttttaaaattattttattatttttttatcctgctgctgctgctgctctaattcaacctctcattccttcttgcatatgctgtaacctcctagccagtcttcctgtcatttcaaaaattattcttaagtttacctacagtaaaattcatcatttttgtgtagctttgtgggttttgataaatgaacagagaggtaaccactactctaatcagtatacagaacaggtcagtcaccccccaaacatatttcatgatgagagtttgtactcaaactgcccgccaccccctaacccttagccctggcaacttctcttctcttctatatccctagagttttgtattttccaaaatgtcatagattggtatccttctctttcagcacctgttcccagcccatccatcctcttcgtcaatgccatttatcttcctaaaacatctctgttgagcaccttgagaaacacttagtttctccaagcttcagtttccttgttagaatgtgacccagccagagtataaaataaggagcatacagaattctaatactttctaaggaggttggttcctgaggaggacccttcatcttgctaactggggcaactgatgggcagatcagagaagcaggaagtcactctgagtaagaaatggtggcctagagctcttgtgagaaaagggatccaagaagggggtagtagagagagaagtgagagacggagaaaagagaacaactgccacaagaagcaaaacgctggagagggacagatgtctacagaagatgttttgggacagttttgctgttgaatgagtgccagtatccttccatagtggcctcgggagacctgtagttcagacccgtgttgtaggaggtgtcttttgaatgggtcttattttgaggagggacccaggagacccagatctgcaatggggataatgacatctgctccatgcaatcatcatgtggggatcatggggtagcaagataggaccctgcctggcagagattgggcaccaaggactcccttcccaccatcctgtgccatctctgccttctctccttacttcttgcctctcacctggaaactgccgcaaaccaaatcctcctacctccccttcaatgaccttcagaatgccagccctgaaggttggctcagaggtcattgtataccaagctacagagtttggtgtacagctgaccttcagggctggcaccagcccactttccagtctacctcccattaaagttctctgtcctccttactttctgctcccaatcctcgcccctactcctgccctaatcttacgtcccagctacgttcaactcctttgttgaaccctcctgcctccccttcaatgaaaattaacctatcctttgtctacattcatttcatgtttattcattttgtgtctacatccattttctgtgtatatatacaataggttttgtatcataattattcatgtctgtttggacacccctgcccccaactgtgtaaaaggtgctcaattcatatttggttaaatgaaatgaattcctaaataatcacagcaagtttgaacctagtgaaggaagtgttaaggcatttcttttacattatgctctcattttaatgtacaagtagcatgccagctatggggcaggttttactcttccagatttcttgtggttgtcaatgcatcaggcagcctgtttccaaacagctgccatatggccaaagctcctcaagtgacccttttatgtgtataagagcaggacatagttcagatatacccaggagaagtaagggcattgaaaacctcccaggctgctgttgcagaaaggacagggagaatgccactacctggaggtgggaaactggacgttgctatacctgcccctccatcaccatcacatagtttgtgtgctgtcaaatttaagttgccaacacaagccatggaccacaaagacatgcttgctaaatcaagttgagtgagatgcacttctagtactttccaaacccatgctgagatgcagaacccccagccccatgcagacagatttgccctgcatggaaacggtgcaccctctcccgctacacactcagagatgagagatgagcctgtttgtgaaaccaaactcaggattctgtttttgtgtaagaaccgtaccacatggctgacatatgttcagtccatggctggcagaagcctcctgaacacatcccccatccagtacctccccggcagtgacccatctcatatttgcatatgttcccctgtcacaagattgtggggagggtgcagtttgcagctgactccttacctagctacagctccaactaagggcgtgcattcttggggagatgttgggagcatcacaaggtccccttccgttcccagaactcagtttcagaggtcagccagaaagagaattccagaggtcagccagagagagaaggtagcaaggacagagcccctactgacatttttcttcccacccatcccatctccagggcaatggtcttcagcagggaacaacgggccctcattccctgccaggggagctgagtacacacaaactgctggatgggcgagaagttcccccagtgatctttatttttccgtttagaaagaatccttattccagccccttctctccagctgctgcgtgtgagcctgtctctgtctcttgggtggtgcagctgcaggtgagccagctgtgggcggccctgaaggacagcgaggtagggagcctggttgtgaggtctctgctccctggggatgctctgcagccttttgcctgcagcaagtctgaaaccttccatgcctgactccccctttccatttttttcctggcgtctgcccttgctggagtggagcatggtgggagccagcccctggagccttccaggattctcacagtctgtagccagagctgtgtaggcctgacctgggcccagcgggaggaggattttgaataaaaaccagtggttcctctccgtccaaaccccccacccctggaatacattgcaaccaaatatttactcaaggttcccccttgccatttaaaaataagatgcttcacctactagcctggcggtgttctctgctctgaaattttatgctcttgagtcatacatttgaaggtagctttttttggatttaaaatttcaaactaatgaagttgtttaaagtaccctgtcgagtgctgggagctgcttaagcattgccacataagcactgcagaggctgggtctggcgcatacatgccaggcaaagtctgccttgtttcaaataaccccaggaagagtctctctacctttggtgcaattcagatcttaggaataggacttctggggtcccctgtttggggactgtgcttagcacacacacttgggtccttgcatgaaagcctgcaaaagtatacgtgacttcctctcttttctcctcaaccactgcacccctattttggggtattcttagacttcttagtggggaggcagaggtggttgatgatgcgctcccagtcagtcctgtctaccttcttctacctcaaagggcttccattaacatcatccaggaagtgttataaatcctgccacccaggccacatctcagaccaatttaataaaaatatctgggctggagaggggaacccaggaattagtattttttaaagctcctcagaagtgcccccaggccaaggctgccagcaccatatccattcgtcagcgcgctcagggacacactggtaccctgtgtgctgacctgctgcagttagagtgacaaaagccggattttgattgtccagaaaagtaagggttctttgctgtcgctgtggagtctccagtcagattttccattggaataggaaacaaacgccaagtttattttaaaagtgctcttgatctacctaaaactaggaagcaggaagaatcctcggggagcagttgagtctcacatttgaatgtgtctttgcttcctctgaaccaaacttcatggtttcatccattaccaaagaggccctggtgacttaggagggatagaattgaactgaaaattccgggatcgctggaaaagtgatttaaccagtttttcaccacatagggaaagttatttggtgagataacagacctcgaggccctgcactcttctgcgtgtggttctgggttgggatacggttcccatgagcagaagatcattcctggctgattttgttcagtgattatttgtttaaaactttaaaaagaagaagcgcagatacagtacatttgtactcagctagccacgcaaacatctttaggctaagaataataaacaactaaattagtggtttgttttattaccaaactggtagagtttcacaggcaggaaaagacggtacctcccaggctggagaaggttaagtatttttgtcaaggaagattaaaaaccctaaaagcttttggttgaattttactgaaatcagaacgtgaatccatttgagagctagcaaccaaagacccgtagaggtgacatggaatgtttttaattctgagagatgggcgtttcagaactcggaaaatgacatttgttttgacatttggtatttttgttgccatacttactgcctttagttcttagtggaagtagtttgctgctcctaattacccaaaaggcaagaaaaaaataactagaaatttttcaaaagaggggaaataggtcttgaaagtttcattaattgcaaaatgaaattaaatggagcattcaatagaagtacttctcagaaccaatggagaatttctcagaaagaagcccattaaagctggattctctaaagcagtggaaatcccaggaacaaaagccaaatgcctgggaattgagtttcagaagaatttttgaattggtacagatcagtaatttacaaaatggaatggaatcactgaatgttctaaaatctgttcagctaaaatgggataataaatttagcttacatggaccctgcacattcaacttgtgctattatgatatatatatctatatatatttactgctatttattaagcattttctgtgaaccagggcctatattttgacatacatgatcttactttgtctaattacaaagattcagtgcctttcacagaagtcattagtagattttgggagggtcgtgttgatgactttttggtgttttgagtaagtaaaatgtgtaatggcatttgagatattgaatgcttgttaaagctgaccttgaaaataagattttcattccattgccgtgctttacaaatcaaactgccatttaggagggaaaaaagacaaataaatgaagtcaactttctttatttcttaaaccatgggttaaactgggtatttggacagatcgttttcaaggccactataggatacttcaggcaagtattttgaaacttgaaagcatttctgataaacttccagggaaaattctgatcttttggtccatgagagaaataactgctagttacaactctggattggaatcgcagtttgaagataatcagaactgcagcttaaacatcatcaaagagtgacctgtagcttagctttcttaattacatgtgtcaagaacttgtgataacagacctaattgaaatgacttattgagtcaggtaacatttatgcccttttaattaactataatttttaatttacctgatcagcattaagctcactttagccgacaaaaggctatgggctacagtcaaattgcaaatagaatacttagtaaatgtgatagtattagctcctactatggactaatattagtttggtcttgaccagaagaaatccttgtgcgtatttatgttgaaagatgaaataacttactgaaattgttaatgaagtattggataagctactttaaaaataacaaacccgactaccagcaacaacacaaataaacaaaccgtcagcctaaggtggacatgttggcttctctctgttcttaacatgttaaaattaaaattaacttctctggtgtgtggagatgtcttacaataacagttgctactatttcttttctttttctctttctttcctctctctttttctttctttctttctttctttctttctttctttctttctttctttctttctttctttctttctttctttctgagacaaggtctcaatttgtcactcagagtgaagtgcagtggcatgaacatggctcactgcagccttaaccttctgggctcaagaactcctcctgcctcagccctgcaagtagctgagactacaggcacgtgccaccatgcccaactaatttttgtatttttttgtagagacaggggtctcactgtgttacccaggctggtctcaaactcctgagctcaattgatccacctgtctcagcctcccaaagtgctgggattacaggtgtgagccatcacgcttggcctattgttagtattttttaataatttttttaaattgtggtaaaatgtatgtaacataaaatttatcatgttaaccgtttttcagtgtacagcttagtggcatgaagtttcttcacaatgtcatgcatccatcaccaccatttatcaccagattatttttttcttctcagacagaaactcaggatctgttcaacagtaatgcctgttcccccacgcctgcagccttggcaaccaccatactactgcctgcctctatgaacttgactactctaggtacctcgcataagtggactcacacttgtgactggcttgttacactaagcatgatgtcttcaaggttcatccatgttttggcctgtgtcacagcttccttcattttgaaggctgaatgatattccattgaatggatctactacatattgtttctccgttcatttattgatggatacttgagctgcttccccttttggactaatgtgaataatgctgctatgaacggtatgtacacatatctgtttgagtgcctgctttcaattcttttgaaattccacttccagaagtggcatttctggatcctattgtaattctatttttaattttttgaggaaccatcatactgttttccatagaagctgcaccattttacatttctaccagcagtgtacaagggttccagctgctctaattcctgaccgatatttcttattttctggtttttcaagatggccctcttcatgagtgtgaagtggttaacttattgtggttttgatttggatcttcctagtgattaatgatgttgagcatctttcttatgtgcggattggccattcatttatcttgtttttagagaaatgtctgttcaagttctttgttgattttttaaaatcaggttgttttgttgttattgagttgtaggcgttctttacatattctggacgttaatccgttatcagatatacaatttgcaatgctaccatttcttgaggcttacagtatgccagatgttctactaggtgctttatatataggatcttaattcattttacaaccctgagaaatagatattatcaccttcatttaatagatacggaaactgaggctttgaaagtttaaataactcattcaaggtcatacaattagtcagtggcaggggtaggattggatcacaggtatgtctcactccaaagcctatgatctcatgcagtttggcatggatactcttctatctttttgatttatgattttccttcatttaaaaaatcttttatttagaagtataataaatataccaaaatgtaaataaaatataaatgtatatcccattgggctattttaaagtaaacactttgtagccatcatgcaggtaaaagaaacagggcattgccagcccccataaggccatgtcccctgacaatcatagccctgtatcttccaccaaaggtagaaattatgttaagttttatggtagccaattccttactttccttacacatttaccacctaagtatgtcaccctaaatgatataaattagttgtgcttgttatttaacttcatgtagatgaaattgtagtgtatgtagtttgtgttttgggcttcatttgctcatagttacgtttgtgagatttcatgaagctaaagtttgttcattttccttgttgtattttattgtgaaagttcacccactgtatttattcatcctgttgtttttgttatgatatataatgctgctgtgaacattattgtacctgttctttggtgccttgtgcatatatttctattgggaacacaccaaatagtgaaattgttgtagatgtaatgccatgtatgagagttcctgttgttttgtatactctccaaacttagaactgtcagtctctttaattttagccattctggcatgttcacaggagtatcacattgtgggtttaatttgcatttccctgattacttattactaataatcttttcatatgcttattttcttttagaacgtgcctatgcaagtctcttgtccatttttcaactgttttctatttcttatgaatttgtaggagttctttgcagcttctggctatgcatccttcattaattttgtgtgttgcaaatatattcttccattttgtgacttgtctttttagtctcaaaacagaatcttttgatgaaaagaatttcttaattttgatgtaacctcatttatcactcttttccttcatggttggcacttgttgtgtcttgtttgacaatgttgcctatcccaaagtcatgaagattttctcttatgttaacttctaaaagttgtatcatttgtcttttatatttatatctacataatgcacctggaattgagttatatgaatgctgtgaatttgggaggggcgtgtttcctttttttcccacatggatatccaatcaactcagccacatttactgggggaagacatctttttttctaatgcgctgtagtgttaggtttttcaaaacttaggtgtctgtatatgtgtgggtctgtttatgagtctgtctattcttttccactggtctgtttcctacacttgtgccaatgccacactgtcttacttatagctctataagtcttggtattgttaaggaaaaatatttgtaacatttgttaaaaatggcagagaagactttattcaaggaggggaacattgtgataggtagagggactgctgcaacgaggtcttgctgtggtgaggagagagattgggctggagtccaacttctacaaggacaagaggggatttatagtcaagcagcagggtggggtcagtggatggaagaggaaacatcagagacaggggtattcttgctagaccaactcaacagaattcttgctgaaggcaggccagggtgataagatatcaagagttaggggtgaggacagataccaagggtggagaattttcactaaaactagtaggattcttgcttaaactggattctataagacagaaaaggaagcccaaggtcagggtctagtggaagagaaggctccggggagcccgacctgagtttgatctaggagagtctttgtcaatatcctgtagaatatgaccttcacctcattttcttttcctcaagtgtatctggactgtatttggccttttgggcttccaggtgacttttagagtaagtttatcaagatctacaaaaatagctactgagattttgatttgaatagtatttcttcctgataatttctgagtaaaattcattttaaggaagtaggaggggcagtggcctgatgaaaagcaaaaatgaagaaaagaataaggaaagacacagttttgccatcaccagccagtgtttagtgatcttaaaatagctgcttttgtttttgagcatcatttgttgggtatggagttgcagaagttgggttgagggacactggcttctagaatcaaatattggcctccatagagtgtttctgtacagtgagttgggaggatgggcaggggccactgaggactgtggcgtgtccccacgttagagtgtatctcacacagagcctgtcctgaaaatatagttatttttaaaaagtgtttccccctccttttcattggccattttctcttttactactctttacctagcaaagggtgggcatgagaaacctggtcagtggaagagaaagccattttgcaacagtggttataggggtgggagagtaaaatttcctggttcctggggaagctaagcccattggtaggaccagacttttgtatgtgtgtttcttcctttagtcatctactaaggttaataaataccttaaaaaaaaaaaaaaaaaaggacatgatctccctctgtcacccaggcaagtgatcctcctgcctcagcctcccaaggcactgggattacagtcatgagaccctgcactggctcattaacaattttttttttatatagagacagggtctcgccaggctggtctcaaatgcctaaccttgagtgattttccttccttggtctcccaaagcattgggattacagacatgagccgccacacccggccaagaagtgccttttatgtctcaggcactgttcttggtgctggggaacaagatagacaaaatcctcactctcatagagcttaattctagtactagagacagtcgagaaattattaaatagaagatgtaatgttgagctctgataaattctataggaagaaaaaggagagtcagggacagaggaagggaagtgacgaaggagccctgtggatctctgagagaagagtctcccagacagggggcaggtggagggtccaggacaaaggctgggcatgccaacaggggagaaagaggtattgcagtgggagggagggaaagtggcgggaaatgagatggaggaaagcagccctggccagacccaaaacctcacttcttatgatagatatttagtaacacccttttcactcttcaatgatgaaatttgtagaaaatataacctatctacccacatcattacaaaccatccatacaatgccttaactgtaatagaaaggaagtacaaaaggggagaaatgtatcatgaactaagaagtatttcatgactacactggaagacataatggtgtggtcatatgttttgcacccacttgtaggatcactgcaaacgtggcagctataaatccagatggctgcagatgtgttatattggccactcaaatgacataatcggtgttgactttagtgatgtgatatttctgaaatggtgaatacgtgttagtaaagttctaaacaaaacaaagtacatcattccctattgaaatccagcatttatgaaaatcatggaggaaacccttgtgttgacaggtaaaatggcgtaggcttttcagcccttccaggggagactggaaagtcctgggggacatagaatatttgtggcttgtgctagaccatcccatgtactgcaggttgtccagcctgtctggccccaccccttaaatgccactaatgactcccaattgtcctgtgactaccagaacagcccccatggatttccagatgctttttcaagcattttgggttttgtttgcatgtaatgagaagccagcagacagtttggatcagggaagtgaagtgacccaacctaggttttaaagagatctgccattcataaaaataatgaaggggaggctgaggtttctgtgtcacttagcaaggactcggcccccaagagtgagctgcagaggtaccaggctgacctctgtctgtctcaagcttagactcacccagaagtctgtctttctaccccagagccacctagaccatccatcagaggcctccctctaatgaggagtagggtgggggcaccccatggtgtcctttgtgccctaaaccctttacaataacaggtgttggctgtcacctgaagcaggtttcaaccatcactcccttcccaccatacacacactcccagctcattttgattccttttcctgcaataaataacagattcttgcaaagtggttagaagaaattagtaagttaagcctcacactagggttattttgccaggagaccttcctttcctaggtaaccccctccaccacgtgggcaccccagtgggatctgctgcagtctgcgccagggtttgcttggcctgcaagggttggccatggcagatgcctttcctgtaactggaatcccccatgcctggccttccagacagtagagagataattggataaaccctaaactggaaattacaaacaataactactctgttagtttacatatgaaactacttaagcaagtcctttttatttttatttttcgacaatatgaagctcattattcgtgacactcggggcactctcaaaatgtgctcaagaaaagggtcacggctgtgtagtatttagcaccagaatggaaacacccattccaagttctcttccatcctttggccactgagaggtttggtttagtggtcccggggaggacaggaaggggagagccactttaacttgctgttgttgagtgaaggtggggcaggagtgaaaggcattgttgttgctgagtgtgttttcatgaaatctaaccttatttaacatgatctccagtaactcactggtcttcaagttacataaaccttgatcgaaaattatttcccttttttttttttttgagacagggtctgactctgtcacccaggctggagtggtgcagtggcgtgactggctccctgcagcctcaagcaatcctcctgcctcagcctcccaaagtacagggattacagacatgagccactgcacctggccttgatttttttttatataaaaggatattagagcaaaagagtgaatatgtataccatagtggtcaaataaatacttctgcaggggccacacacaaaactgtgaaggcagaatctatttctgtccttagatgtgttggtcaataggtgtttgggcccgtgaatgtaggacccaaatgtaatagcagcactatactctacagcgtgtgcatagctggattcagaatttttggttttaaaaattaagcttttatttatatttacccatcaggtcaccgaatacttggattcaaccaaatgcttgaaagcttcttcatttgggggaaggtgggtttggaggcagaaatccctgcagactccacacccggggttttactaggtcctccgcggcaggtggaaggaaagcttgttgccctgcagttccgtttgcttcaaaaacaagggtgggaagggttcaccaattgatctttgtgcatatccagtgtaggaaaagtgttatttagagtatcattataaaatcggctgcatatggtggctcatgcctgtaatcccagcactttgggagtccaagatgggcagatcacttgaagtcaggagtttgagaccagcctggccaacatggtgaaaccctgtctctactaaaaatacaaaaattacccgggcatggtagcgggcacctgtaatccccactactcgggaggctgaggcacaggagaatcacttgaacccaagaggaggaggttgcagtgagccaagattgcaccactacattccagcctgggtgacagagcaagactccatctcaaaaaaaaaaaaaaaaaaaaaaagagtatctttataaaagcttgactcccatggtagatggacctaattaaggtttaccagcaagtcccagatattagcatagcataggaaattaccgtagaggcatgtaggagtcatccagatttggccaactcagaggatagagagaaaaaatatctctccctccttcctaatctcaagggagatggaaaacaagaagatttagagcttcaagaatgaggattgaggaagtacaatgtaaaaatggctccctgggtcccttcttggaaaaaaatgtccagagagtttccaaaagtggttttcccctcctttttgaggaatatgtgtttttattcctttgtgaagaatatcatcttagtagtcttatttcatttgtctatttccctctttaatattaatttgatctgagatgcttgtaaagaccaagcaacaaaaagatgtcatgccaccttcatttgccaccatcacctgtgaagttcagacaacgcagtatagacagagccttaagagggaggagtcaggcgtgaggctttgtgaggggtgggtggtcaggggtgtagccacagcctttgatcataaaccatgaccggttagaactgggaggaacctcaaagtcgctaggttcaactctctcatttcatagacacgaaaaatgaggtccaaagagttcaagagactgccaagggttgtacagctaatcggccgacctagcaatcgaaggacagatttgagtatttttttttaaagcataggcttttaagttctttatcattgtcagtttactttggtttgcctttaaccttcaccaccccagctggtaagtgtaaattgtcattgttaatgtgctttttccttgaactgcttgtgaaggactctctttcaaaggagccggtagaagggaggaaagttggtggcatattacatatctctacgctgagattcaatccagaacggccttgggagttcttcgtcggctgacacaaggcaaagccccagctctgatctgaaaagtttgtatgatgcattttccatgtgtattggttgattggttttgctggaagacctaaccaagagaaagcattccgaccctggcgttagccccactcatgagtctactttatactttctacattttgtctataaaatttgccacttaaaaactcttgtttcatagaaaatggacttgattatctgtatcattatgaaaatcctgctgcattatcaaatcttcctaaaaggttaaaaagcttttttttttttttcaatctctgtctttgctgtgattttagactgggttgtaaacaagctataatgtgaatggactaccaagagatctacaacagaagcagcctcagaaatagaaattgaatttataggcagtgagataggataattagcttttatatttaaaaatatcctcagaccagaggagtctgctgtctcagatagagaagggaattgagtttgaatcctaatgcctcaagtaatttagtagaaactgcctgttttatataaaatatatacggcagcctgctgtgtgtgtatttatgatctgtatctctatattcctctctaaacacatgagttaaagtgtcagtctaagtctgaacattcagattacacaaatcatttgtacttataattctcagccttaaatgttgttgttgatatagctaaagataacctgattggccaattatctcccttttttctttgagtggttatttggagttcaaaaatcaaacaaacaaaaaacatttctgttttttttacatggagagcaagaattgtctcggatgtttacccgaagttttttgttttttatccaaccattatgcactacagaatgtacaatttaaaatgctctatgtaggttaaacaataaaagacacgagaatattaagtgtctgctattgttaaatatgtgtaaattcaacatacctcctgtaatggccagtgtcttagccgctgatccctgtcactctgaattggcagaaaccagatcctggcttgggatcttgaacagatattttttccagggttgcatcacaactcttgggagggcatcctgtctgaaatatgctgtctccccagcctgggtcagcagggacagagagaaatagcatctgtcagctgggttgaagtctcccgcatatggagtcagtcactggttctttgctgagggttcagctaatgagacttgattgcttgtggcactcttgtttccaccaaaaagagcctaaaaacaggatgaacttgaaaacaagaggaagtggtgctatgcttccccatgactttagctccagtttgcctttgagcaagggggaagcagaaggaggaacttcttacgtacctgcacggtggttcataccaggggttcatcaaccctgggatcttgcccccttctctgcctcctgtcataaatctctgtttcaaaggaaagaaaggggatggttgttaaagcataaacctccaggtcagctcttgttacattagaccccaagatgatgtccaaaaccttttgttgaactgaaatgctagcttggtttgaaataactgagccattcattgcctagggatagaaaatctttctgttgtaaagaggtggttggttggttggtgtgtggctttgtttgcaaatacagaaagtgggatggggattggaatagtattggccttgtgggggctgaatattgaaagcagcaaaactggatgtacctaaaaactaaagttgaatcggcgagttcatccatccttttagagctattttcattgagatataatttctttcagttgcttgaagttttcagcatcagatcaagttttctttcttgctctccaatacctcttttgcttgtttgccatctgttcatttccactgcaaactgctctttacacaatgttactcggtgttaattagaacacgtgtctctttgtcattcatctggagaaggggttaatgatgatttatgtccctttaattggttttcctccaaactgttaggtttaatttattattttataagaattccaagagactgggaaagaggaagagtgcctaatttttattcttcatgtctttaactatatatctcttttgctttaaaaaagagcaatcttggcctaactattttggtgttttaaaagtatggttctttggccaggcgcagtggctcatgcttgtaatctcagcacttcggaaggccgaggtgggtggatcacttgaggccaggagttcgagaccattctggccaacatggtgaaaccccatctctactaaaaaacacaaaaattagccaggtgtggtggccacatgcctgtagttccagctactcaggaggctgaggcacaagaattgcttgaactcttgagaggcggaggtcaaaatgagctgagatcgcaccaccgtactccagcctgggcgacagagccagactgtctcaaaaaaaaaaaattcttcaagttcttattaaatgataatacatatgagtatgtatttactgcttatcagtgaacaatttattagtcaaatttgttagcttatttctgaataagtaacatgttatcatggttcaaaattgaaaaggtcccaaaaggtatgcagtgatttctttcctcctcctcctattgtccccagacttctattctgggaaaagggtttcctttccgcagaatctatgttgtcagggtcttgtgtgtacatatatttgtatttatgtatacacatatgtgtatagatggatatatgcataggtacatatatatgtaaatactttccctctttttatgcagagggtggcaaacatatatgctgttctgcatataccttttaaatgcattttggaatgtactgcctatcggtaggttaagagcttcttctttctttgttaaggctacattatactactgtatgatgacttattaactacttcctgactgatagacatttgggctgtttccagtttttcccaggatgaacagtgattcagtgaatagctctgtatcacattattttgtatatctctaggaaaaagatcctagaaatggaattgttgcagctgaaagtaagtacatttatcatttcgattgattttgtcaaattgccctccatagacgttaacagttaacaattctgctagcaatatgaatactcgtcagcttttttcatacttgtgaaaatagtaggtgaaataatgatcccagcttatggtttaatttgccctttcacttattttgagtgatgttgagtataatgagcactttaaaggaaaaaagataaatttttgtagttagatgtatatatatacatttcaaaggtggaaacctgtttgtgcattttcctttctaccccctcaaaacactaggaaattatacctagtttctagtaaattagatagctaatttctatattggtgtgttattaacagtaaatatgctgcaaatgttggaagatacctaacattctccttcatgtgattaccaaaaacatattgctgaaatccaatttcgactgacattatttttcaaaataatacatttcaaactaatcaaatcaagttttgatttgtaagggcacattacatgatatcttttaagatacaatattttaagtcaattaaactctgatgtatgttgctttttaccaaaagcacacagattatggagaactcaccaagtgactgacatgataaaaaagcaaagttcttttagataaaaatggccactttctccttgatatttttctatgggttgagatttagatgaaaatcccttgtggcaaattttaatgactatttctttaatgtaataactgaattcatctagatgatcccacgtccctcaacagagaaaggtgagagtctgttatttgttaggtttccttgtccatatttcttggtgggtcccacaaaagtctcatgaatctctacaagtgggaaaataaattgcccatttcttggcacaccgaactttccatgtcatattttaaaactgtaagtccatactttacatagctaaagaccaatgggccaaagcatggtgggtcacacctataatctcagcattttgggaggccgatgtggtaggattaattgagcccaggagtttgagaccagcctgggcagcatagtgagaccccatctctatagaattttttaaaaaattaccgatcatggtggtgtgtatgcacctatagtcctagctacttgggaggctgactcaggaagaccatttgagcccaggaatttgaggctgcagtgagctatgatgacaccactgcactccagcctgggcaacagagaaagactctgtatttaaaaaaaaaatggaaaaagaaaaaaagaccgaataataataataatatgtaatatttaatactttcatggattgggtactgttttccctcccctgtgagtccctgcctatgtttccttcaggccataaaaagaaagcttgtctggcaaatatgaaatttgaaaactgaccatctgctgaattataatagtagagatttacctttgggataaatatatttgtcattgccacaaagtttgtgaataatatttctgttgcccagtcatgaaatcaacaaacctccaaaatgaagttgctttaagtgtgtaatggcaattttgaattgttaaagtattccacactgtcgtgaaaccaatgtaaacccttgctcagaactagactcacaaaattttagagccagaaggaggtttggagatggtccagcagttcgtctcaattttataagtgaaaaaaactgaagctggggcaaggttaggaacatgttagcaagtgagtgaatgagtgagttacaaagctggcatccttgaatcttggccccagacctcacctggctaaattgttccagaaatcttgcctaaacacactttttttgtagtggaagaatgtatgcccttttagaaatcagttctaaggtctcttagtaaaaccatgtggtaggtcatccttaactgggggttggttttgctgaagacagtgagcacaagagaaaaccacagaatgctctttctaagaaacatctagacagcactcatgaggcatacacttggtgttccctccctctctttttcattggtaggctgtaaattactcccctgttggaaaaataaggtcttcaggctactcacggtggtgtgcagacgcacatacacaacagtgacagctttctagtggcttccgccatgcgtgaaaagagatgcaaaaggaatgcaggaatgttagagaaaataaaggcatcgccgctgattagctgggactgatcagagatgggttacttcacgtgaagcatgtaaggaaacctcttgtaaagacttttattatatttttaggaaggaaggaagaaagacagaagagaaaaacagagaaggaaagggaaggaagaagggagagagggaggaagagaaagacagagggaaggagggagagagcagggatttacctgcattacaggtagcataccttctccaaagtctcctttgtggaccagagggaccattggtggcagctcccttaaccacagtccagaactttcagtattaaaaacttagctgatacctctcaaggatatatatttactgcaggtccttcatctgaaattcagacacatgtagctagctacagatcacctataagatgtttcaacctcaacaaatttgggacttaacccatcatcttactccctccgccacttcctttgcttgatcttcttatctcagtgagttgcatcacagtcctccaaactgatgaggtcaaaactctggtaattatcctcaattctttcttctgtcccacctctagccaccatctaggtcaaacagcccagctgactgcacctcctttgtgtcttccccactccatcccctgcctgctgccactgccttagttcacagcctcatcatttcctccttgagttgctgcaacaatctccagctggcctctctgccacccagtttttgcctctctccaacctgtcctcctgactcttgccagagaaatttttctaggaaaacctacccaagcacggaatgcccctgtataaatgctccatgggttgctgagcacccccagagaaactgtcgtgactgatccacgctctcacttcctcggccttgcatcgtgctgtcccctgccctcccaggctctgtgccagtcacccaggcttccctcagtgcgagcatctcctcacctcctgacctttgcacaagccactccttctgaggagcactctctgtttcccctgcttctctcctccttgcctaactcctactgagctttctaatctgactttgagggcacttttcagagatgtcttccttgaccaaccgagtagacttatttaacaaacacttgcataaatttactgtgtgccaggcactgacctaaaggctttacatatattccttcctttacttctccaaactttaggagaaagggaggattccagtccccattttatggatgaggaagctgagaccttgcttgagtggtgaagcagcttgcccaaggtcacacagccttgtgggccagaagctacttctgcctttgtgtggctcctgattttgatttgtatgtagtataaatatatatatttttgtgtgtgtgtgtgtgtgtgagagagagagagagagagagagagagagagagatttatgttccaaattggttccgggtttgtcatctgtatatttaatatataataaattatatatacaatttattttttgaatagacaatagaagcacatattataaaattcaaaaaatacaaagtgtatacagtgacaggagcctccctcctcactttacctcccacttctccccaaaagcagctcctgtcacccatgccctgtgtatctttccagggatatttacaaatatatatgtagacactatgtgattttcttttatatttatgatagcctattctgcttgagatttttaatttgctttgtttgattaacagtataccttggggcttgttccatatcaatatattaagagcttcctcttctcttctgtgtctacataatagcccattgtagggatataccatagtttatttaatcagtctcctttttggatatttaggttgttctcaaacattttctagtacaatcagtgccgcagagattagcttcctacagacatcattttgcacacatacgagttgatctgcaggataaaatcctggaattggaatttgcggccaaagggcaggtgcatttataattttgatagatagtgccagattgtccctcataacggatgtactcatttattttctcattagtagtttatgagattgccccttccttcttagcctcacccttgcctatataataaaatgttttgatgttcacccttctagtatttttaaccagcttttttcttgttatgagtcgttatgcatcttttaatgtgtttatgaactatcttgattttctttattagctgatttagtattcgttggctcttttcatattgatttataggcatttcctatatattaaagaaatatatcctttgtctgtgatctatgttccagataggtccctggtttgtcatttgttgatggtgttttttccccatgcagaaaatttttattttcatgaaatcagatttatcagttttttttcttttatagcctctggggtttgagtcatagttaagactgaccttccccacgcctaaattataaaatcctcttctatgtgcatgcatgggtgtgtgaggttgtttcaaagaaagaagtgatagagtgtaatcgctgagaaaaccaactgtggagtcagactgacctaactgccctggtttcatctctatttctttaatcttggatgaaatgtttaatgggttagtaatatctatatcccagggttacaggtgactatgaagatcacataccacaatataggaaatcgtcctgtattaaattactgatagctgtttttattgtgttattttctccaagtttaataataattgcacaagaacaagggccctttcttctctttcttttgctttccccttgccattgtggcccttccccttcccaaactctgctgccagcaagaccttagcgtggtgctctgctgatgggactcgagtgctcactttgattgcttcactgtttattttgattggcgacagagaggcctggagttctggctggagccacctggagtgccacaggtgcttctccacttgccacgcagctgttctcccagtcccttgaggaccctggcgcctctccagatcttggcacttggtttctttccatgggtcaccggtgagagtccgtgttctttcctttgggccccctgcagccccttgccacagaggcctcatcccgagaggacttgagacagcgtactccccacatgggtgccctgtaaatatctttgaccaaagaagttaggagaagtaagaggtttggggtgtcatattgactggaagagccacaaatctcttggctatctcttcgttcccattgattacacaggaaggaattattccaaatcatgtatttctttagtggatgatccccttaaaaatttctacgatgtcagtttctgttaatatttactacagtttttattgtcatggattgtaacttcttaaaaatatttaatatcatgcaagctgttcaaagacaccagtaatttggagacagtgcagggaatcgggctgtgatttcctggcttttatctgtctctgctgctcccttctcctctcctttgcctgtttgtgtttcctttgtacactcacttttaacaaaggccccttgaaattccaggggtaggagacacagtggagcattgaggtaggtcatctcatatttaattttgccactctctggccgttaattaaaataatgcttgagtgctagtgtccagttttacagggggtgtgtaaaatgttaatcacaactgatctgaagcatccagtccagtgccagggagagggtttagggcacaggcagggagcatgttatcaggaaaaaaataaactagaggaaataaaacattttgttgttctttaaaaaattttaatatgaggccctactatgagcaaatatgaaggaggatgtgaagacgggtaaggtgcagtccgcggattcaaaggcggggccatctgcatgctgagcgttttactatactattccatttaagattcgcagcaggctgggcgtggtggctcacgcctgtaatcccagcacattgggaggccaaggcaggtggatcacctgaggtcagacgttcgtgaccagcctggccaacatggtgaaacccggtctctgctaaaaatacaaaaatgagattcgcttaaacccgggaagcagaggttgcagtaagctgagattgcactattgcactccagcctgggtgatgagagtgaaactccgtctaaaaaaaaaatttgcagcagtccagaaggtaggccccattattccgattgtatgggtgaggatactgagttgaagaggagtaacttgacattgatcccattgtacagtggagccaagattagatccaggggacctggtttcccagccccatcacctcagtcctattgcattaccctctggaaatgctcagtccagtaaaggagagagtgatgatgcaatgatgtgactgcttccagtgaagagtaaaagtaatgaactagaaacgggagaaacagattgacacccttgagttgtctttctggttagggcttttgggtttttgttctgtaatacagtccaatgtggtggccattcaagggagaagggccactcatcagccctcctgctccctcacccccatcttaattaaataagtctccttaggatctcacacacctgcatgtaacaaaacaggttttaaaaatctgtagtcaaggagcactgcttgtttctttctggcaacaatcccagtggaagtaaaattacactggactgcctgaaactctgagcccaaagcgttaatttttgaaaaacgtttgaggttcctgagttcccgtggtatgctactagaatattctgtagctttaacaactcccagccttcattctgcactgcaccccccgcacacccaatacctattccacatgtctggggataggtcagctcaccgtccaccctcgctgccccctaggctgaggttccctgatgagcacagttttccgggaaggatttcagcccctctgtgaaagtcttcagttatctcctctcttgtttccagaagtagcttctttactccaacttgaaatcttgctgtattccttagtgttttggaaacaaaatgtgcagtaggagaattctggctttgtggatattggatcactttgttccctggcacaacaatctctcctttgtattaaacatctgagaacagaagtcctaaataacatttttatattccttgttgatgtaagttctttatttggggacagcagtttggtacttgttcctctgtcaaattctgatgtactttccctttttcctatgatgaggacaccactgacccctagcctggaattttactttgggtagtggtggtatttgcttaccccgtgggactttcctgttgaatccctctagtctgcagtgagtggcctgtgtcatagtgggatgtctgactggtcggagcaaaggtacccaatcctccagcctgaccatgagctgggtggtgaactagccagccacaaacaagccagatggacagacagaccaaaatagccacttgtccacctccttcctggaaatgcagaagggctgctccggaggtccaagaagacctaatttggtcagcaacccagcacttactctgaacaggaggtggagttgtgagcctggtataagttccctacctccgattctttacttttaccacacacgtttgcacatttcaaggagatgatcagccacactaccaactactgatgggtaacaaatactctttacgtcaaagctcttctgatgattttcctggattctgtacttgtacaatgaatgtacttgtgcctttactccaaagaaaattagtatatgtggctgggcacagtgactcacgcctgtaatcccagcactgtgggaggccgaggcaggtggatcacttgaagccaggagttcaagaccagcctggacaacatggtgaaaccccacctatactaaaaatataaaaaaattggctgggcgcagtggctcatgcctgtaatcccagcactttgggaggccgaggcgggcagatcacttgaggtcaggagttcgagaccagcctggccaacatggggaaacattgtctctactaaaaatacaaacattaactgggcatggtggcaggagcctctggtcccagctacttgggaagctgagacaagagaattgcttgaacctgggaggtagaggttgcagtgacctgggatcatgccactgcactccagagcgagattctgtctcaaaataaaaaaaaaaaaagaaaaaataacaacaaaaaagaaaattagtatatgtgctttactctttaggcaaacccaatattatacaaattcagttttttaagacaggataggacattttatttttcagaaaatgtataaccacattccttaaatggcgtaggtagtataatataaatatggtttatcccctaagaccgtttttatttctatgtgagtttcaaagctctccctttttcctattcattcaacaactccacgctgagttgtcttatgggaggaaaggctgccctgcatggctctcttgcagctaatgaaatgagcagttggctttggtgttttatcactttgggtcagagatctatttcttgctccttactccttcagtgaatatctagttcgtgctccctatggatcaagcatcgtgctggtcttcttccatctgccttgttcccagtgggagcagttggaaggatgctgatggtttcttcctccaggagaggaagggcagtgtttcatgtcactcacaaccaagcagctagttgtcggctcttggaaaactagttcaccaaagggaagcactgagcctgaggccctgggatgggttggattcttttctaagtggaataacattctactcctcctgcttaacctttccttgcaaactaaaatgggaaaatcactctatggacaaagtcaagcagaaataaaaaataccctctctgaggcagcctggcagtacctgcatgaatcagccagtgtttggataagaagcagcccctcgagaaggaatggagcccttccctggaccttaattgatttttgtatttgttcttcttcttttaattctttgtggaaaagtgatttgtactgcagagtggctttaacatattatgggtgctgttttatgtaatactgttcttatctaaagatcatttctgcttgttttgccctattttttttcctgatccagctcatgtttgtttttctttttcattttatttcttctttttgaaggagttattgttcctcttatttctcccacttcatctacccccgttatctgccaggagaataggagaagacatgggccacttttttttttccatttttaaaatcaattggctagatatcacctttctctcgtgagtttgtttcataacgcagagcctcattagtaacgaacctgacccttaagaagttgggttatgtttattcctagggattaaggcactgttctggcctggttggccctttgctgtctgtgctatcgtccgcccctgctgaccagggcgtgcctggctcatggacagggcagctccttgcagaggtaccctgctgtcagggaaagttctatggactagtaactgctaagatcttttttgataaaatgagatcttgaagccttcaatcatgagcctcaaacaatttacataataaatccagaacttggagatccaaaagatattgccatgtttttggttatgttgctagggaactatgcctccgttttcaaatgatacattgctgtgtgtgtgcgtgtacatgtgcatgcatgtgtgtgtatgtatggaatgaggaaaattaggtgtttcatgcttatgcattgtagtgaaggctacagtgttgttaggcttttctgatggatatcataactcaaactacagaatttgtttacagcagtgttcatgtgaccaagaaaaaaaaaagcagatgaaaagtagccagacgtgttcaaaacacaactaatagatcaggtttctggaacatctgagtctaagggtttggtcttcctcacaatatgttgagaggtgatgttttaaaagcaaaaacggagaaaaggccagctgtggagaatggtaactgagacaattagaaagcagatgtgtgcaattgaatgtagtcagccttaaatggatccacactctcttctgtatgagggtctggaagggagagttcacagaataaaaatggagtcattttattctttctgttcaatatagattcccacatacagcgagtatttgaattgtgacttgctttctcattggcgtaattcccacctgcctttggaagtccattccgaggtgaccttgccccctgcaatatggaatgggaaaacacctggctgagtctagacgtctgataaccacgtaggtgggtaaggtaaccactgggatggctggaaggtgttacccagggaaactgaaggccaggatgaaaataaaagcaaacggtttccccttgggcaatgactgccatcaggattctgctgctgataaaatgctgctcctttgttctgcttcctgcgtgttcatccatatgatagctgttagacatttcattcagctttcacccacctggcactgcttcagtgccaaccaacggcaaggtgctccccagctgccatggggagccgggtacaaatagacctcagcgaagccctgcgtgcatgcaaactgcgtttgccttttgcattctgcttttctctcggggccatgcttgggacacttacacgctgcccgctttctttctgtgatgggggctggtgcctttgcactaggcccccacagtcatcaatagccctgttcatgtgggaggtgacagcaacattttgccacattacaggctgcagggctcaatgtgaacattcttcttagagtgagcaaagggcatgggacttctgacggccagggaagtcacagcctgcaccacagtgcgaagatcctccatctgggccatggggagcacttagaatgtctttttatgggttcaataaaatgtgatgaacaaatgtttgtggtgaagctctattgtgaggttttctgatcatatgtaacataattactgaaatctttgtcaggcattgttttgcatttttatctacaaaggaagccagtgacaagctcaccactgttctctgttttccctttagtcggttcttaatcatccaagtcaatagagaaaatcaccatcatcgatgacgcaaacccgtaaaaagtccaaaaataatttgtgtttgattttgagatggagatggtaggcatgtgaacaaaacgtgccaagacatttaggctactttgaggtccaggccaatgccctcccaactcggctctgctccccctgaagccggagaccgtgtatagggatctgggggaccggagggcaacgccagagaacaagtggaggaggtggctatcaatcctcagagtttgtcatccactatgaagaaagctggccaggttttgttctgataacatcacatagatattttatactttttaaaagatgatcagagtgacatctgtgtggttaaaaagccaaataacacagaaggcttttaataaaaaataacagccctgcctgggtcctgtccttccttggtcccactttccagaggaaacacctttgaaccctcccagctttgttgaaagttctttgggtggctaccttcatatctttaaataatatatggtagtaccatttgtactagttttctagggctgctgtgacaaaataccgtaaactgggtggcttaaaacaatagaaatttattatctcatagttctgagggctggaagtctgtaatcaaggtgccagcatggccacacttgttctgaaggctcagggggatccaccccccacctcttccagctcctggaagtgccatcggtccttagcttgccctctgtgtccctgtgtgtccctcctcacatggcattttcctctgcctataaggacgcagtcctattgggttagagcccaccctaacgacctcctcttaacttgattacatttacaaagaccgtgtttccaaattaagtcacatttacaggtactggggacttgaacatatcttttgaggggacataattcgacccataacactactctttctcagtttattgccttccttttatagtcaatggggtttctctccctgattcagcctcgtctgtgtcttctctcagacctcttccctctccatgctccgtccctccacttaaaggacattgcttatttctcaaacaaattcttggaaacctcatttctcattctgttgaccttagagagcatcacttaattactcatttaaaaaatgaaagcattcactctttcggctcccatcttctacctctgagcctctgtcagctagggccaagcttgatgccatccgtgttcttttcagttccctgaatggttaaatcctctgtcatttgtcctcagacgaagaatggatatttgtctacagcttctattgataggatctgaaagttgaaaaccaataaacagtgttatcgtgactctgtctcctggattattatacctttgcatgccctctgggttttaattaaaatactttataccatttgaaaaatgacagcataatttctgtttgtttagtactttagaatctacatttatttgattttagatggcagcatactttgcttgctctgaattgggaaactgtctattcgtttttcttgatgtcctttggcattacatattgaaatgaggctttgtgtcttataaatgtttgatcacatgacacagtagccgcatgggtctctctgtgagtttttagcaacaggtaagccattctaaggtagtgctagccaaactttggatttcaatgcttttcatttcttttttttaaagaccaatacagagatgctaactttttattttgccagaatgggatattaataaatcagctattatttactctcactggtaaaataagaacatttaacatgaaaaacaaaatagtaaggacataaccttggaataagttacacaattttaaaaattttgaatgaatttaactttcaaagaactcattactttccctcatttttcccatttggcatagactggtgaaaacattctgaatggaatggttgtcctagatcaaccttgtttagtggccatgtgtctggttttaatagagtagaacatactgttaatgactctgcttactctgtagatggttaggttgattgattaggacctggtatggaagatgtgcaggagaagggggcaggctttgtgtgaagtgggagagttggatcgccctattttgtgaccctaaactgtaagtagaaccccataccccttgccacatgcccctagtctaagccatttgtaagctgagctagctcacaaattcttgcccaacatgtgctgtgttgggcatgaatttaagtagatacatacagatctgtcacctttatatatgtagcccttgagtaagtcacgctttcactgtcttaatttattaccataaagttggccgggcatggtggctcacgcctgtaatcccagcactttgggaggtcaaggcgggcagatcactcgaggtcggaagttcaagaccagcctggccaacatggtgaaaccccgtctgtactaaaaacacaaaaattagctgggtgtggtggtgcacacctgtagtcccagttacttaggaagctgtggcagaagaatcgcttgaacctggaaggtggaggttgcagtgagctgagatcacaccactgtacttgagcctgggtgacagagcgagactcggtctcaaataataataatttttttccataatgttgtcttcccatatatattttaccagcttgaggtaatataactagtaaaacttaagcattcaaccaatgcacaatgacaccatttttctaatcttctctgactaaactaagtctaaaatggaatattattgactaaatgtatcccatcgactatatttgattaattaaccatcaggtaaaattctttctctccttaaggaagaagagattgggattaagattggttatcagtcatacccttgccacattgaattgaattcagttttcagaatgttaatgctttaataggaagttttgtgaaatcccttcagataagaagaaaattaatttcttacttttttttttttggtaagaaatgtttgtgtgtgtggcggggggggagggctgcagccaaccacaggtgattttaatgatggtaatatatagcaccttcctaggaccatgtggtttaaaacatcgatgaggtcctcttcacaacatccctgagaggcatttagatattgtcttcccatgtttttttgcacaggggaaattcaagacagactgaggttaagaagtgagtagcccaagtttagtcagcaggtcaattgcaaagtgagaaaaggaagtccagctctttcaaaccacatctcttatcctggctaatgaacagcatctccctgagtccatactctcaactttaagattccactctaggccactttactttttgaagatctgaacatttgaatgaatcagatacggctttccaattagaagtgtagacagtcgtgtccctcaaggtttcattgtaaggataaatgaaggtggtgatgcttttgagcccctgggacataggccagtccccagagaggaggaagcagctctgaaccagcagcatccctgagtttgatttgtttatcagaagtaatggtttggatagagctgtccacactgtcatcccattttattggtgaccaggaacatataccacagaaaagttatgaattatgaaactagagaaggtgacaagtgctggctttatgctgctctagctctgtgtcacttaactcttttggacctcagccatgccatcagtaaaatggaggtcatgatgttaactcctttccgttgtctttcatcctttgattcttctaaatgcccttcatcggaatcaaactggcagccgtacacttgccaggtctatgcacacagcagtgagctctgcaatccaaggaccagatccaagtacagatagggcccatgttttgcagctttgcattctttctcctctacatttcatctctgcctgcattccatgtcacctttggaagacctcatatgtcactgtctttctgccctcattgaacagagtgcactacccgtgagcttccagtatggtgccttctggcaatctacttgaagatatgatcttcattttggttgaaatctaataccccatgtgaagaacaaggacagtacaactcaaaattctggaccactgcatatggtatcttttctataacccatattttaaatacgtgtattaatttataacacaaacatatggatgtttcaaataacgttgggctataaaaaactggtattgataattgtgaccccaatgatgagaagcactcatcagaagaagaaggaattccattttttttttttaaggcagggtcttgctctgttgcccaggcttgagtgcagtgacatgatttcagctcctgcaacctctgcctccctggttcaagcgatcctcccacctcagcctcccaagtagctgagatcacaggagtgcaccaccacacccagcttttttttttttttttttttttttttagcaaagacagggtttccctatgccgcccaggctggtcttgaactcctgacctcaagtgatccacccgcctcagcctcctaaagtgttgggattatagacgtgagccaccttgcctggacaggaagaaggaactctgtctaagcacatttttggttttgtccagtcatgttgtttacacggccattgttacaaagcagaaaagccaccaggcatctctttacctctgaagcaagcattctaaatagttgagagtttgtggtacataaaaagaagccttctctcatgctaatgttttcaaaacaagttgtgacttctgaaagtagagaccaaagaaagaataacttgaacaagatttcagtgggtagaaaataaacactaactttatatgtatttcaagaacgtaaaagaaacaggtgggaaatgaatcctcctcgataagagagaaatgcttagtagggtggaaaaaaaaaaaagacaacattcagcagtttttggaactgtgcgagtccagagagtttctttctttctttctttcttttttttttttctggttagctctcatagccacaaatatgtatattatttccttcttgcccacaatttactgagaatcatctttctaatatactggggaatcccaaataaaaatctcatttttctaaacacagacaagtcttttaactcctgcaattaaatgattcaactattcatatgtagactgtaaaagaaataatcaaattgttctagtagaaatctccaacggccatctcaaatagtttccttcccaaatttatactgtaaacggcttaggtttagggaggggttttgccctagtcactgatgttttgaaataggactcagaaacctctttcataaagtctctgcggtgattgggctaccccagcaatgtgatatagtggtaggattacagaatattttaacccttttctgaatgttgcaatatattcttatatgggaaatgattgattattaactacttagaatgtgtttcttttccaagcatgtcagcagagtaagtacagcagacttcgtaggcgatcagtgtagtgtcaggtgtgagcagtatggactggagatggtctgcctggattcaaacctctgctctgtcctttcctacccaggcttttctggggctccttctgctcatctgctaagtgccacgtattacagcattttcctcatagggctgctgtgagctttaaatgcgtttatgagttaactgcttagaacagtgccagctatgtaataaacactacgtaagtggcagctacaccatgcataaacaaacgcaaactgtgtgcatctgaggaataattctagttaacattaaagtgtgtttttgtgtacagagttggtgtctgttgtctgtgcattcactttttaaaaatcgggaaatagcagatgttaggaacctatttattttgcttgctcttccttctactttctgcttgctacctactctattctagttccagacttgatctgtttctctgtgcagggttgctcctatgtacaaccaatgcagaactgaccccatcaaatttacaaagtgtattagtctgttttcacgctgttgataaagatataccttagactggacaatttacaaaagaaagaggtttattggacatacagttccacgtggctggggagacctcacaatcacggtggatggtgaaaggcacatctcacgtggcagacaagaggagaggatcaagtcacatcttacatggatggtggcaggcaaagagagcttgtgcagggaactcccatttttaaaaccatcacatcttgtgagactcattcattatcatgagaacagtgcagaaagacctaccaccataattcaattgcctcccaccgggttcctcccacagcatgtgggaattgtgggagttacaactcaagatgagatttgggtggggacacagccaaaccgtatcaataggtatggaaggaagtaaaatactattttttggtaagagctctcccactaagatatgaggacatatgcagaaagtgaggaaataaaactcaaagaaagtgaggaaataaaactcaaaattggctttcaaaagcaaattttctgtcagtaagatgtgacacgaatgttaaagttttaacaggttttgtttccttgtaaatatttacttcactatatctaataatctttgtgaatgaagatctcattggtgtcttttttaagatattaagaatattaggattacttatatttgaggactaaaagattggtagagacataattctatccttgtggcttctttgcatactttaatgctaaagttcagtacttaagattgaataaaaatgtcttgacaatcagatataaaataccttctttgggctgggcacagtggctcacgcctgtaatcccagcactttgggaggtcgacatgggtagatcacctgaggttaggagtttgagaccagcctgaccaacatggtgaaaccccatctctactaaaaatacaaaaattagctgggcgtggtggcaggtgcttgtaatcccagctacttgggaggctgaggcaggagaatcgcttgaacccggaaggtggagtttgtagtgagacgagatcacgccattgcactccagcctgggcaacaagagagaaactacgtcaaaaaaaaaaagaaaaaaaaaccttccttagtgtcagtcactctttttcttttctttctttctttttttttttgagacagagtcttgctctgtcacccaggctggagtgcagtggcgggatctcggctcactgcaagctccgcctcccgggttcacgccattctcctgcctcagcctcctcagtagctgggactacaggcgcccgccaccacgcctggctaatttttttgtattttttagtagagacggggtttcaccgtgttagccgggatggtctcgatctcctgacctggtgatccgcctgcctcggcctcccaaagtgctgggtagtcactctttttcttaaggttacacagtcatggttgactttgtaggggctcaggacatgccaccccagactatcatctccttttccaaggactgttccaatataatttctagtacctgagagactttctctgcataataagacacacttgacccaccatacagagcctcccctcatcaacgcacagcttgtgtccccaccacccccagaagccccaagcccctattccgttccatagctcaggatgctaaatgagtttcaaccgtgtgacccttcttcaagtctcatattttgtgggactcccatgtgcacctacattattaaatatggggtttctttctgttaatttgtcttacgtcaattcataacccagccaagaaacccagagcggtggaggaaagccatttctctctcccctacaacttttaaatactaaaattaaaaatgtccccacccaccaatattggaactccgtggtatccataagctgggttgcatgttagtgattgtaataagcaataaaaatccttgcatgtcaatattttattaaatttgattattcatggatttgtgaccattattatttgctgtttattggtttgttgttgtttttaaaatattttacttggacttatggaccacatgtttgtttcagaaattcttcaaaagacagcaaatccctagtaagtgggaagaaaaatcacttaacagtattccaagtacctcaaaagatgcaaatatggaaagatgaatatgaaaaagggtactcctagagtttatcaattgtctatccctggagaaagtttccattctccattaagactccaacggctttgaatagtatatgcttttgtgtatacaatgaaaataaaccatcatcatcgtcatcatattaactgggcttgtgcccattgtagatttcatgaaaaataaccaaccatcaaaaatgacttgacaggagaagccaacaagccctaacattaaatggtcctgtaaaagtttgcaggtatattatttgtgtattcagtaatactctcaattagtgtttatgacttcattaacttaattcatttttcatgaatggtaaaaattcactctttcctacattcacaaatgataggctattttgatggaaaaccaaagactcactatatgttctcctttgcagtagcggtagtagttgcagccaccaacttcagatgtgcagttcctagtttactatgtgattcagtgtgcttttattgagggcctccttgtcgagagagagtataatacactagcaggagtatatgttttggagtcaaactgttcttggctcagatcctggcacagctacttgcttactgtgtggtcttgggcttcctggtctgtaaaatacccgccctgcagagttcttgctgagttgaagtgagaggatgtatgtgcaagtgtgcggtgcggcattcggtgggtactccacagcactggcttccctttccttccacactgggggcctgctcctctaattcctgttcaccaagtagacggggaggaagagagtggtgcctgaaactaccattttttttagtgagtcaaacgtgtcatgttgtgacatcttaggcatgtcccttcaccctgggggtcttggttaactcctctgttaaattcagagcttgcctttttttttttttttttttttttgaggcggagtcttactctgtcacccaggctggagtgcagtggtgcaatctcagctcactgcaacttccgcctcctgggttcaagcgattctcctgcctcagcctcccgagtagctggagctacagtcacgcaccaccatgcccagctaatttttttggcatttttagtagagactgggtttcaccatgttggccaggctggtcttgaattcctgacctcaagtgatccacccacctcggcctcccagagtgctgggattacaggtgtgagccaccacacttggccagttgacctttactttatgattatttctaaagcacttccagatctatccttctgtgatgctatgatactatgaagcattaagttgagactaggagattaacagtagggtgttaaatggacaggactgatcacaatcttatatggtgaaggaagaaccaattggacttagtgacacattaaatgtgattagacatgaattggaaactattttgaggtaatgttccccaggatgccctctccaaaacactagttgctgaggatgggaatagatgttaattgaaaaaaggtttctgaaaagcatttgggaaatgctaacttcaccaggtttctttcctgcaggacttctctgattctttaatatgcccatatgcatgatgattctgaaattggggaatgtagtcatagtaggaagcatttctaaagcttatttcttcatggaatcagaattatgttgcacccaagtagcatcttacaggaccagtatttcatggaaaatactctgtgaagtgctgctctatggttttaaaccaagaatgaggtacaatataggggcattgactcaacccagtgaatgtgctgagcactgacctcgcaagatcctgtggagggcggaaatggataagatcccacctctgcaacaaggctggcaataagccattagtggtggcattgtctacatggctaatagcagggatgccttgggggagacaatatcccaccgaattactgatgcagattcagttgaggcagtatccccagggtgcaaagtcctgatttctctctcggatgtgcttattctctgtctctctatgaagctcttataatggtattagcatccagttcaccacggagaaattctgcagataaaatgaacgtaggagctaaaccaatgggaagtttcattcaggagaagattttacaaaatggactctttggacttcgtttttgagtacatagttatttgaccaccatttctacacttggccttaaagtcaaaatataatctaaggcgagaagtctaaaaactatgtagtagacaaccttgctttactgtgaaggacatggcatctcaatgttggcagaacctgacgacgtagtttgtttttatttctcattgatgaaagatgagccagaggcctgatggcagattttactgggaaggaccttttctcaccggtcagatccgtggattatttcaccactggatttttctgcctgttaggcctttggaaacattttggcagattgagcagttattttgctcatgttgtgagtagcgtttctctgaccttttgttatttactgaaacaatccagcctgttttcttttaagagaagcgtgaaatgaaggggagtcagtcagcacatgctgactctggtatcagaaggctaacttttgggctgcttggcaccatgtatgcttttaaagttatggggtcattggcctctttgtttcttattcccatgattttgaaggagtcttttgggggaatttttttttccttgctaaagcagatgcatgtaaggttagtaattaaaaaaatatatttcactatgtctataaacataaccctctaagttttcttacgacatcttgggcatggtagattatctgaagcctctcctcttttaaacattgatgtgacgtgatggggaggccagcttggcactggaatggtggcttggtgacagggcatccctcactcctgacctctcatgaccttgtgagtccagacagtggaggtgatgacaccattcaggacgctctccaccagccgcaacagggaactccttctccctagtgctctgcctacctatgcccagaaaacctatctccctgatgtttttctggttcttcccctagtagaagatttccattctttgcaggttgacttgcaaggataaaggaagtaccaagatcctattgtggccgggcgcggtggctcacacttgtaatgccagcactttgggaggtcaaggtgggcagatcacctgagatcaggagttcaagaccagcctggtcaacatggcaaaaccccatctctactaaaaatacaaaattagctgggggtggtggcgggcgcctataatcccagctactcgggaggcttaggcaggagaattgcttgaacttgggagggggaggttgcagtgagccgagattgcatcattgcactccagcctgagcaacagaataaaacttcgtctcaaaaaaaaaaaaaaaatcctgttgcatcttcaaagatgagaaaatgtgcgtgtgtatgtgtacttgagtatatgttcattcctatctccccatctatctacctgcctactgatctctttctagcccggtcagaaaattcaataggaatcatggcttttcattgggattccccatagcacttgagctcagctgctagtgttgaagacatcactcaaatttgtcttgtttattctcgtagccaaacataaaaatgatcattacctacataaactaacctagatgatcattaattgaggctatttaataatgatctgcatgtttgacaatcaccattgtctaagaatgggccatggctttaggaatgtttcattcatttcttcagtctttcagtcaacaaataacacactgtcctaggtgctggggacacagtgtgagcaaagggacacaattctcatggtgccacatgggcaataagtaaaaccgaaaaataagaacgtggcagacaacaaaatggataacgtagggtgtaactggggaggatggtgatatggtttggctgtgtccccacccaaatttcatcttggatcgtagctcccacaattcccacatgtcatgggagggagcgggtaggatgtaattgaatcatgggggcgggtctttcctgtgctgttgtgataatgaataagtctcatgagacctggtggttttataaaggggagtttgcctgcacaagttctgttattttctcttgtttgccgccatgtctttcgccttccaccatgattgtgatttataattttctttataaattacacagtcttgggtatatctttaccagcagcgtgaacacggactaatacagggggaaggctagtttaaatatgagtttcacaggacctgtttctttggcttgaggcctgtgagatgaggagccagccctgagaagtcctgaggaaaaacttggagacagaaggaagaacaaacggactcctctcccactgaatgacctcatgtatatgtttgccacttgggactatgacctgatgcctctttaaacctctaggtcattgggaacatccacaaaacagctgaaagatgctgttttgttagaatgctcgttgtaatgcaggatgctggtgaacccagtgtgaacttttcaaaaacctattgatcccaccccacccactctctagagctctcatattgacaaaggatacctttcacagattagaaagtcagtagactccatttcttagaggaaagttgtggaaaatacttaaaaatactgtgagtagaagaaagaagcagtttagagcttcaaattcaatcgggctaagttgggcaagctactgccttataggcagtaactttctcatagaactttaaaaagttttattttgcaataattatagacttgtgggaagttgcaaaaatagtacagagagggcccatgtactcttcatcctgcttcttgaatggtaacgtcttgcataacaatagtaaatggtatcatgtatatagcatcacattatcaataccaggaaactgacgttagtattaggccttaaacagatttcaccatggtttatgtgcactgatttgtatgtgtgtgtgtatctcaccccatgtctagattcctgtaaccaccaccgccatcaggacacagggttattccatccctaccaagaaactcccttgtctccctgtacttttatgtatgagaaatggcagcagatgctgtcctgcttttagtctgaatcatattctggaaaaatctacagtgagagaaggtggatgagtctttgaaatctattggttgaaatgtattggcactgagaatctgcttaattgatatagaaatggagttccttggtctgacttatatgaagaccatctacaagctcagaaccaaaaaacacaggtttgaataagtaaccctgaccacattatgagagtccatcagttgatgctcaattggtttaagaagctaataccagtcatgtggcctgagtagtttatttctaagaagaaaactctttctggcaccacacaacttgggggattaataatatatatatggagcgtttggcacatttctcgaagatgacccaggaagcagacacaccagtaatgggttaacaggtcacccgaagagtgggtgcattccttatggaaaacagaacacatgatagaaaaatagccttttgtgtgtggaggcaagaaacctttaggacgtgcagttagcagtgagaacttaaggaaggtgcaggctgaaatggaaacacgctataaacagattgagagagagacaacagctttaagggaaaacatctgtctggtggatctgacatccaaaagttgcatctgtggtctaggaccaatcttgtaacgcttaaaaaaggaatccacagaggcccaaagcgggctctgaaagtttctttctttccttgagattttctgtttgctctgcccagaatactgcctaggacggatgaaatgaactcatctggtcctgtttctcaatgctgaagtagcacgccagagaagttaactttagaacagttggttgcagcaacattttacctggattattctagacatactgataaggggagtccatttactctgccaaacgaaacttctggaaatctttttttttaaagacagtcttgctctgtcacccaggctggagtgcagcggtgcgatcttggctcactgtaacctccgcctcctagattcaagtgattctcctgcctcagcctcctgagtagcaggaattacaggcacccgtcaccatgcctggctaatttttgtatttgttgttgttgttgttgtttttgagacagagtcttgctctgtcgcccaagctggagtgcagtggcgcgatctcggctcactgcaacctccgcctcccaggttcaagtgattctcctgcctcagcctcccgagtagctgggattacaggtgcctgccaccacgcccagctaatttttgtatttttggtagagacagggtttcaccatcttggccaggccagtcttgaattcctgacctcacaatctacccacctcggcctcgcaaaatgctgggattacaagcatgagccactgtgccgggcctaatttttgtatttttaatagagacgaggtctcactatgttggacaggctggtctcgaactcctgacctcaagtgatccacctgctgtggtctcccaaagtgctgggattacaggcgtgagccactgcacccggccgcgaaacttctagaaatcttgagagtgactcttccaatattttgtatttcaagtagaagttttcagtaataatgaagttgaaagccagaagagaggagcagataatgttctcatgaagcctcagaagacattaggagcatctatctcgatattagattgaattgaaaatttgtcatattagtcccttgacttattcatattttttctcttgagccattggtttgtgttctgtaaacacagcctaagaggctattttaaaggaaatggagatcaggtgttctccatagattcccatgctcgatttcccggagtgggagcaggagagaattatgagcaaagagtttcagccctcaccctgggacattacccctcctccctgcacagacttcacagtgggatgctggtgaattttttaatgttaatttttatttttaaatttaacttttattttaagttcagcggtacatgtgcaggtttgttacacagataaacttgtgtcatggggctttgttgtacagattattttgtcacccaggttttaagcccagtactcattagttatttttcctgatcctctccctcctcccacccttcatcctctgataggtcctagtgtgtgttgttcccctgtatatgtccatgtgttctcatcagttagctcccactaataagtaagaacatgcagtatttggttttctgttcctgatgttagtttacttaggataatggcctccagctccatccatgttcctgcaaaagacatgatctaattcttttttatggctgtatagtaagtattcattccatggtgtatatgtaccaaattttctttatccagtctatcactgatgggcattgaggttgtttctgtgtctttgctattgtgagtagtgcagatgctgatgaatttgcacttcatattcagtgattttcgccttgaagaacataccttacccaatccatgttacttgaagacgaccgtaactgaggtgtaggaatttgtcctaaattactgtaaacaactttttggggcatttcacaatattccagcgcctctccgttccctttcattgtcttctccacctgatccctctttcaaactcttgtctttatttttatacatcttaccccaaacccagattgcagtaagattcctatgtgcattgccacatgcattttcagcaatttgaaattttatctaatatcaattaagctggtataaatcataccacttcacatacgtgaagttgtttgctacagccctgttctggagaacggtgagaatgccctccttgttttgtggcaggggtgaggggggatgttttaatgaggagagactggtaataagggattgtggtgaactggcaggggaggaaattcaataaacagaagagaggaactcaggatagttgggcactggagtgttgcaaataaagcaatatgtgatgctctccccatggaatgctcacctacgctatactcagaatccctgacagccgttttgcactctccaacactggcacacaatggggtctcagggtttgttgaaataaattgggctctatatcatgtgttccctgatttctcctcaataatgtgtgcttcccagccctgcattgaaaattaggacatcaagtgacattgaagtcagataatctgcctcatgtcacatgggttgaatgtggtagatgtgatctcaggtcttttgactgcctcatggcaccttccatttccaagcctctgttttctcatattcttaaggcacagaattcatcccattacttggtctggtgttgaggagaagcttggcataatggaaagactcaaatttcatttttttttccttcttagaagaaatctgtagaactgtttcatcacaacctgtggatagctgacgcagtttgaagatctacaccttggagtcacccatctcacaaaatgtcagccggggtgctcattggtacattgtttgttgtatatttcctcataccttggaaaggactagttgaatttgttccaaaccaagcaattgacctaggactttgcatcctattagtgtcggccacaattcaaatccaactccttttcaaagttgtattttttacgaaaggtgacctgatagcgagacaagagtaatgacgggtgaggcactctcaaatcaggccagggtggcaggccgggacatcttgttttcatcagattctcgtagttactcttgacttttctgtgtgtttgctgaacttgtgagattctattgtgctctttctagctggatattttccagagggttatcaagaaaaaggagtatcttctgcattaataacctcgggaaggattttagcagtaaaattagagaccagatgatctgctggacagcaggatgggggagcatttcttcccctttcccaggagagtgtcaagttcagcatgacctagcaccagacctttcactcagtaactctgagatcttatcatatcaagttatctcagtcatgatgacgtaaatggcaaaactactacccttatttcttgggataagaatttttcgctttaaaggaatacaatatacaaaataggtgaccatgaaatatgcttggtgggtcagctaatttccatatgtgctttgtgattggtttttaagtgaatttattgctatagagttccaaaacaaccctttaacatttatgttttctgcactttgtctcattattgaaaataacaagcgctatgtaaaagcgtaaagaatatactgaggtttacagcaaggataaccaccaaagaccgggagttagaaagctatggcctgtgggccaaatcttgctcaccacgtgcttttgtaaataaagttttattggaacatagctatgcccatttgctatgtattgtctatgtctgctttcacactgcaacatcagagttgagtaattatgatagagaccatatggcttaagatatttgctatctggtttttcactggaaatgttttccaacccatgctatagatattttcatggtatttatttactgactcgtttgttcattctttcagtggacaccaaccctgttaatgacgctggggaatgtaaagataagtacatcagtctctaatttccaagagcttataatgtaacagagacaagttatgtactcaaataacagagacaagtcatgtattcatctttacctctgaccaggcagaatgcagcacgtactacagacaagaaatagctaaattgctgtggtagtttagagatgatgagagcctccgacaaaggcagggaattgggaaatgcacaaagatattgcttccataactgtggcacacagtgatttcccaatagggaacttcatgagaaatcaggctaatttccttcatggaattttataaattgtagtatccaaaagagtggaagtgatttagaatattactttgtgtccagattcctttatctagaagcatatttcccctgtaactatggggatgatcatatttatagaaaatttttgaacatttgaaggaaggcttcctttatcagggtgggaagacagaaggaattccttttcttttttgctgattgttcacttcacagtgtaatattaaatgctatgggtcttaaagaaaggcttctgtggggaaaccctcaaatatcaagtggactataaaaacaagataggctgggtgcagtggctcacagcggtaatcccagcactttgggaggccaaggtggatggatcacttgagcccaggagttcaagaccagcctgggcaaggtggcaagaccccgtctctaccaagaaatacaaaaattaaccaaacgtggtggcacgtctgtagtcccagctacttgggagtctgaggtgggaggattgcttgagcccaggagggagagattgtagtgagccaagtttatgccactgcactccagcctgggagacacagcgagaccctgtcttaaaacaaacaaacaaaaaatcaagataaaattatagaaccctaaccatggaatagcaggactcagtgacaattacatctctctcttctccacaatgcatgcgagtgtgaactgagattttggtaagttcccatttccctttggcctattgaacccctttaagggttcagcccccaaccctgggaagattccatgcatgaaaactacccaaatcctcccagttgggattaatgtgacctgataaagagttctgatttttttttttttttgagacagagtctctctctgtctcccaggctggagtgcagtggcgcgatctcagctcactgcaacctccacctctcgggttcaagcaattctcctgccttagcctcccaagtagctgggattacaggcatgcattgccatgcccggctaattttttatttttgtagagacggggtttcaccatgttggccaggctggtctcaaactcctgacctcaggtgatccgctcatcttggcctcccaaagggctgtgattacaggtgtgagtcactgcgcctggcctgatttttgtgtcaccagaattgccttgtccattatttgtgttttccaaatatctattgaattaactcgaattggatgcagacagacattgtgcactcaaaacctaggtgattgatttggaaaaagattcaagacttttaggttagtctaagagatgctcaggggaggccccttccattttgcttccagcagggtgtcaaagttattggctaaattccagcctccctttctttatactcataacaataaaggtaccagcatgaatgcagcagagttttgttttagaatataatcctgtgaagttttaccagccgaaagcataatatttggatggataaaatgtgtgtttggtgagaaagctactgaaggaacataatattggacccccaatcaggtaatttaaatgttataggaagcaccaagcccacctatttcacaggcccccgcctctcccctacccggagtagcagggctcccgcagttagccatcccacagctctccaggggctctgctctctcgttaccaagaagcacatgccagcccgtctcccagcgtttcctggtcctttcacaatagacagatggggatgctccaggtagagacaaaagagaacacacaatccatacgctcatcttgctggtacccttccgctccctgagcccaaagaggagaacccagccctctgcgtaggaagaacacatttcaaggcatttactgacaagtaggtatagttactgcatacacatgtggaggctgcattatatcaaaactgtaaataaacatagactctgcacactccttcaggccccaccatgtatttatgaatgggattgcttcatcattttcttttaatgtcagtagcagggaagtcagaaagcattacctctaaaacggggacagaacattgcaaatacatacatttccaaccagctgtggcaataaccagcaaacaaaattacttcaccccgttgttatgggccccatgcctatgggatttttcctgagtttctgatttataacaatcacttttgaaggcctcaaaatgcttaggtgagattaaattactgattatccaaaagttctgttttcgctggagtctttctggacggctgctgattcggtcccatttaaagcattcggtggcatgaactcactcggtttctgcccacatcactgcattcctgggatgccgttcacaggccttagcaagatcatctgacagccgcctgtgaggtcaacgaactttatacataattaaacactcccagttaggagaattcatttctttctccctgagaagcagagaaagaatacatgttgtgttgccctccattacggagtaaaagttgtgtggagtaatcaggctagtttcacatgatttaatgttgaaccgaataagaaagtgattgcatcctctactgggcctcacagaaaagtcaccacccacattgtttattcagactgggatcttggccatttggggtttaagccagaagaaagaggaaaaaaaaaaaatccaaccctggaatgaacgcttttgaaactctgtattcttgatgaaatgcggccaagggttcttttaaaaaaaactatttaaaatcaattaccaagatcatattttcatttacaatgggttgttagcaacagctaattctctgtttccatccagatttggtgtttaagcttcaatatgctggtattggaatccttgccgtgttttgtctgggtatcagatgctaccaccaaactatgtgtggggagttgggcaactctgacctttgaccagctttccataaaataacaaggaaaggtgtgaggaggctagggattgggtgaaaactagcctgagggatggcagtaagtgagcttcaccagggggatgaacatataaaggaggcactgaggatattgctaagggtaagagaaagcaaaagacagaatcatatgccttgggaggagggtcaggcccgttaaggcacctagtccgtctgtctctagccaggactgcaagaaatcatctcagacatgcgatcttgtatcgcatttttaaagatctcaagaggagattccggaacctcccttggtcatccgccctattatttaacaattcctacagccaggaaattctttcttatttccagcctaaaatgtgcatgtggtgcagcttcaggggaggtgattgatcgaggccacgcccacctcccccccgcctgtttactccttggatgggatggtgcatatgtcttgcttcttccttaaaatgggcctctctcggcctccataccacagtccccgggctgggagaggggtcgtggtatagaggtggggtgggggccgaccagcggcgtttatggggaccagccgccaccaggaactgttgctaggcattttatgtatttcccagaggcaagagaacatagctgtgatgtggccaggagtgcgcctcaaaaccacgtgcaaataataaatgcggaagctcccgtttcagattttaaaagaaaagaaaagaaaaaatcctgaaaaacagaatgaagagtctagaatttcactggcctcgagatggtagtctactcctcaattttaaacaagaagagcccagagcagaaaagggacctgtcccggacaagatctcagagctaatgcccctaaacgcagcgcagtgccctgttcttaatttagatagggtgctggaaaggcgaaatcatgctggaacggaggccatcgatctcacttcctccggccccttcctcctcttcggcagatgcgcagtgaatggtcaggccctccgtgagtgaattacagattcattgaagagccgtcagatgactggagcagtctggtttcttccctttttatcgagttctgtcattgtgttcctcaaactgtggtttgttccagaaaggaagaggttgtcttcttcacccgcctgccctaagttgcgtcaagttccagttccctgtattaagtaaattactaaatgagtggaatgaacatcataatgtcaagggtagggcgttgacattatgggacaatagaccacgagcccactctgtcagctttttgtcccgcacctctattatctgtcaaatgatcatattaacactctcctacctactttagggggctcctaaaaacaaatatttattgacaggttatgtattagtctgttttcatactgctatgaagaaatacccgagactgggtaatttgtaaagaaaaagttttaatggactcacagttccacatggctggggaggcctcacaatctgtggaaggtgaaggaggagcaaaggcacgtcttacatgagggcaggcaagagagccatgtgcaggggaactcccatttataaaaccatcagatcttgtgagacttattcaatatacgagaacttgggaaaaacccacctccatgattcagttgcctcccaccaggtgcctcccatgatacgtggggattatgggagctacaattcaaggtgagatttgggtggagacacagccaaatcatatcatcttataaatgtagaacacaaactccatgatatcctttatataaagtttaaatacatttaaaaatatatatatatagtttaaggatacacacatgtgaaagataaaaccatgcatggtgataatgagcattgagcatcacacagtatttttttattgtgaaagatctcgagcaaacagaaaatgcagagaataagattgtgtataaatgtgcattcaccactattttgtcatgtccttgttcttttttgtaaaaaagagatagactttccccatttccacccgctttttccttccctgaacgtcacagtcatcagtttaaatgtgatgctcaatgctcattataaccatgcatggttttatctttcacatgtgtgtatccttaaactatatatatatatttttaaatgtatttaaactttatataaaggatatcatggagtttgtgttctacattgtatttgtaagatttgtccgttgcaaaacatggacctctatacattttccatgctgtgttgtagttatcagatggaggacatggaagttatttctaattttaagatgtcctttggaagaatgctacaggtgtgtctagctttttgatatgttctttgcacaccatgcctggtagtttctcttggatatgtagccagtagcaaagtgatgaattagcacatcgtcttccctggatgttgccaaattgctctccaaagtgcaagccccttctcagcagcagggtctgagaattcctaatgctcagtattctcttcaatacttgttagagtcatatttaaaaatttttttcctttgccaatctgatagttgtttcaggtttcagttgcaatttcctgattaccagtgaggttgagcatattttcatttgcataccgagtagtcaggatttcctccatgagttatctctttctttccttggcccgtttttctattggttcgttgtttctttattggcttattggagtatgtaatgtatgcttgacaccactcccttgtccattatatgcacagcaaatatcttctcttggttttgtaattttattttgttgatgatggtctgctaagagattttcattattccttttgttttattctcataagagatctgtgagctagatgctatctctgtttgcatttttagatgaggatagtacatcttagagagtttaagtaaattgactaaggtctcacagctggtaagtagcagagctgaggatcaagtccagatcgaattccagagcccatgcgcttaaccactgcctctaagtcataactactatgagtatccccattttacagatgagcacacagataaggcccagagaggttcactgatttgctcagagtcactcagcgtggtagtgttggaacaaggactgttcctcaggtcccagactgccaacacaactgtatacctagattgaaatgttggggaaatgatcggtgatagactagataaaggaaatgtgatacatatacaccatggaatactacgcagccataaaaaggaatgagatcatgtcctttgcagggacatggatggaactggaagccattatcctcagcaaactaacacgggaacagaaaaccaaatactgcatgttctcacttataagtgggagctgaacaatgaaaacacattgatgcagggagggagacaacacacactggggcctattggagggggcaggaggagggagagcatcagaataaatagctaatgcatacggagcttaatacctaggtgatgggttgataggtgcagcaaaccaccatggcacacgtttacctatgtaactaacctgcacatcctacaaatgtatcccagtgcttaaaataaaataaaattaaattttaaaagaaaaagaaaatgttggggaaatgtgcagaaaaagatcatgtatacccttttaaacagtaactttaaaaattatgaactatttaatatttaaaatacaaaatttacagagaataatatagcaaacaatcaggtaccccaactcagatttaataaatattgacattagccacattttaaaaatattttttaacagaaaatgttgtagtttaagcctcttttgtgaccccaaactgacagcattcttccacagctttcccagcagtaaacactctttagaagttgcactgttacatacctgttgcattttgctatgtgattatgtgtcataagccaggggtccccagcccccaggccatggaccggtacaggtccgtggcctgttaggaacctggcagcaccgcagaaggtgagctgcaggagagccagcatgaccacctgagccccacctcctgtcagatcagccacggcattagattctcataggagcgcaaccctattgtgaactgtgcacccgagggatcttggttgctcgctccttatgagaatctaatgataaatgtaatgtgcttgagtcatcctgaaaccatcccccacccccgtctatggaaaaactgtcttctattaaaccagtgccagaaaggttggggaccactgtcataaacaataactagtatcattttgcaagtttaaaaaacgaatggtaatgttatcaataatccatctttctggaacttgctttatcacttgaagttatgtttctgagatttatcctaattaatgtatgtagagctaattcctttaactgttatattgttataaactgaatgtttctttccctgcaaaattcatatgctgaaatcctaatcccaaatacgatgctattaggaggcaggattttggaggtgattaggtcacaagggtagagccctcatgagtgggtttagtgcccttctaaaagagaccccacggagctctcttaccccttcactgtatgagggcacagtgggaaggtcctctatgaaccaggaagtgggtccacaccaccacatctgctggctccttgatctgggattccatccttcagaactgaaagataaatgttacataagtcacccagtctatggtatttgtgttatagcaacctgaaaagactcagacataaaccaatttctttctataaatatatcataatatatccactccctaactgatgtttccaggttgtcattttataaacagttctattgtgaccttctctggacttgtttccatgtggatttgttgaacttttcaaagatacagaagaagtggaattactgggtcttggggtacaaacatcataaaggttggtaggcgttgccaaattgctctcagtttgctttcagcaacaatgtgtacaattcttattattctgcatcttctcccactcttgacattgttgggcttttaaaatttgctaatctgatgtattgaaaaggtatttaattgtcttgatttgtatttctctgattacttatgaggttatgtgtttagtgttggtttttcctacggtttttcatcatttgggatttttttctttctctttgtattacctgactctagactttgctcacttttttgtagtgggttgttttttccttatagagtactaagtgttcactaaatattatgaatacttacagaaattttctctctccaaggctatttattgcctttaaacattgttttttggcatccttcatcacagaatgtttaacatcaaatttctcaattttatcttctttccttcttcttcttttttactttatggtttgtatttttttttgtcagtccctcacttaagaccataaaaatagtgtctaaaaaacattttttcctaaatgttttaaagttaactgtaattctcttggaattcatttttggatatagtgtgagttagtgatctattttttttctccatatgggtaacagttgtctgcgaaccacctattagtttagtttttgttttccccatagtttgtaatgctatctctgtcacataccaaattcccacatgtgtggggctctctctattgcgttagtctagttatctatatttacaccaatactatagtgtcttaattttatggcataattaagtatattgtatatgtcttgatatctggtaggacaagtccccatattattctttttcaaagttatcttggctgcttttggaccacaattttaaaaccggttacaaatatccatgaagaaaacctttctgggatttttatatgaatttcattcaatttatgtattaattttaggggatttgatgttgaaattgtggaatcttctcactcctgagcatgagatatatctctgtttatttaggtcttatgagtttcaatgaagttttataatttttttttccatataggccttgcacctctttctttagatttattcctaggtacctcacaggtgtaagatctctattgctaatgacatcttatgaaaattacattttctaattggttgttactgatgccatggatgtttgtatattaatcttgtctccagcgtccctgccaaaccctcttatttcttgtaattgttcatagtttctcatggattatctatgtagacaatcttatcatttgcaaataatgccacatattcccccttcatttctaattctgattttcttactcctttttcttgctttattacatcagcaaggtatctcatacaataatgaatagagtggtgagagagaagacatatttatctagttgctgattttaaaggaaatgttcctaaagtttcttgtaggttcttaggagaaacttccttctgtttctgttggctaggtattttattttatttttaaattgtgaatgggggttaaatttgttaaatgatttttctgcatctattgagatgattatatggtttttccttcctaatttgccaatgtggggaattacattaagattttctaatgttgactcttacttgagcttctgggataaaacctactgggtcatctcacacacattccgtatatttattgtgtgataaacatgatattttgatagatataatctcaaatatgtatattaaagaaatactatatatttgtgcacacactatactgctggaatttttgctaattttttttttcagattttttgcattgatactttaactgagattgaccaatacttgcctttttttgtattgtcttagtgtttttctacaatgtaggtttagactgaactcataaaaatacattcaggattctttgttctttttccatatttttatgtgtcaactttggtaacatatttttctaaaaggttttccattttatctgtttttagatttattgctttaaaatacagaaaagaattctcatgctttaaaatctttactctatttagttatgacccattttatgcctaatagtgtttatttgtgctctttctttttccttgctcaatcttgtcaaatatttacctattttattagtctttttaaagaatcagcctctattttgtttctattctctattgtttctgttttgattctattgatttgttgtctttattattgccttcctgctactttaaccatgtgtggaaaaaggattttcttctattgtttttgagtttacattgttgccctttctctaactttcttaaaatttttcttgtttactaatattaaattcaatgctaaacattttcttcaactgaaatttagggcttcagttgttcagtcctaaatatgttttactttcattttgatttcatattaataatttagcagtgtgcttctgaaatttcaaaatgtacttgggtttagggattgtggttttatctatctcaatttttttattgtattttggttgaagaatgtggtctgtatgataacagttctttgaaatttgttatttgttctgtggcctggaacctgttcaatttttatgaacatttcatgtgcattctctatttattgggtagagaattctcttcccatgtcattagctgaagcttgtataatgccttatttcaatattaaatcttttcccttttttaaaaaaaaaacttgagctgtcaatttcatagagatgtgtactaaaaatctcccactatatgcttctggcagatcatgtgtgttaaggaatcacaaatgtggtaaatgaaacagcatatccaaggcacccatccttgcaggaggataaagaagatcctcatggatgtgacattttagctgaacaggagtaggccaagaaattcttgcattgccatagaggaacaccggagactgggtaatttataaacaaaagaggtttaattgacttacggttctgcaggctgtacagtcatggtgccagaatctgctcagcttctaggaaagccacagggagcttttactcgtagcagaaggtgaaatgggtgcaggcacatcacatagccagagaaggagtaagagagaggagacggggaaggtgccaaacactttgaaacaactagatgtcatgagaactcactatcacaaagaagacaccaaggggatagtgctaaaccattcatgagaaatccagacccatgatccagtcacctcctccttcagcattggggattatatttcaatatgagattcggggggacaaatactcaaatatatcagttaataacagaggacttcattctaaatgcaaaggcacacaatcacaccacctaaataccactttcctgtattctattttcttgcatatttttgacattttcattgaatacctcaatttttaaaataataaattgaatacatgtaaaatgattttcttctatttttaatgtattaagttcaatagagacataaaaaataaaatataaataaataaataaataaaatctcccactataattttgaattgttactttcttgtagttaattcaatttttgctgtaaatatttgacactgcgtcatgaggcatacaaaaggattctggtgaatatatcttcatattaacaagtgatcctctttatccctcaaaatgcttttggctgtaggccgggcgtggtggctcatgcctgtaatcccagcactttgggaggcagaggcgggcagatcactcaaggtcaggagttagagaccatcctcgccaacatggcgaaaccttatctccactaaaaatacaaaaaaccagttgagcctggtggcacatgcctgtagtcccagctactcgagaggctgaggcacaagaattacttgagcccgggaggcggaggttgcagtaagcggagatcatgccactgcactccagctgggcggcagaacaagattctgtctcaaaaaaaaaaaaaaattgcttttggctgtaaagtctgttttatcagatccgttcatttattcattcactgattcaattaaaataaacatttattgaacatttattgtttttaaggaatgtcctaaacactggagatacagtagtgaacaaatgagaaagtccctactctcttggatctgagagatcttatattttatttggagatcacagataataaacaaacaaaatatataatttgtcaggtggtatagtgctataaagaaaaataaggcaaggtgaggtagataaagttatgctggggggtataaagttatgctgttctatatcatgtagtcgtgggcagctcttggattagttgacacttgagcagaggcctgaaggagccacctgatgtttatattgcttatataaactgaatgtttgtgtcccaccaaaattcatacgcagaagctccaacctctaatgtgataatatttggagatgaggcctttgggaagtaattaaagttacattctctactgtgtattccatgcttattgggtggagtgttctcttcccatgtcattaggtcagaacagcagggccctcacaatggcattagtgatcttttaagaaaaagaaggaagagatttttctttctgtatgtacacctgaggaaagaccatgtgaggacacagcaagaaggcggccatctgtaggccaaaaagagaggcctcaccagaaatgaaatcagccagcaccttgattttggacttaccagcctccagaactgtgagaagtaaacttctgctgtttaagacacctggtctgtggcattttggtatgacagcccaagctgatttgtctaatgactataccaagttcttgtgagcatttccctatggtattgctttctcttcctttatgttaatccttgtgttttaggcttctttcttgtaaagagctggagttttaaaaaatccaatctgaggttttctgtcttctaacaggttaaagtcatttatatttattatgattactcatatatttggaattcactaggagcctgaatgttttctatataccatgctacttctttacttgttttttcttcttattctgcctcacattaaattacttgactttttcttacactgttttccactgatttgtaatgtatacattttgtcctattgttttgacagttgttaccctcaaacattaaaaattatatttgagagctgggcgtggtggctaacacctgtaatcccagcactttgagaggctgaggcaggcagattgcttgagtccaggagttttgagactagcctgggcaatacggtgaaaccacgtctctaccaaaaatacaaaaaattagccaggcatggcatgcacctgtagtcccagttcaaattccttcttactgaagtacatccttgaatagctatttcattaaggatttgggaatattaaagcatctcagtctctgactgaaagtatctttaattcactcttggtcttgaataataatttttctaggtatagaattttacatagatatcttccctcagcatttgagtatattatttcattaccttttgatttgtgtaattgataaggtgtagtctgcttcaggctgtcatttatttagagggttctctctctctctctcatattgctttaaaatttttttttgtttttatctttggtgatctgcggtttcaccacaatcctgcttgggattcaagactaagaattcctgacattcaccgattctgaaaaattttgtcctagtctctgaatattttctctcctcagtcctctatttatctatctgagtcctcttttatatgtatattggaccttgttattctctttttcatgtctctgaatgtgtttttcagatttctcatgtctctcttttttgtgttctatttttttctttaacatctccctaccttttttattcctgtccctccaaggtaaccaatgttaacacttggtatgcattcttctacatgtttctccaagctcctataaacacatgcacatatatattcatatatatcttaaataagggtgttttgttactgttgtttgcaaaaaaaatccaatcatacagcatgtattttttcacaacttgtttttctctcttgatagtacatgaaggataatctccagataaatggatacaaatttaattcatttttaaaaatagctaagtaaaattccatgttatggctatattatagtttattcaaccttctccctattaatgagcattcagattgttttcagttttatgtcactgatagggacaggagacagggaaattctgggcagaagagggtgggtcccagtgagggccccaccctcaagctgaaaagcctgataccatggtccaaagggagaatttacatccctgttttcccactcgaatgttgccttttccaaaaccacccatggcctgccctgcctcccatcctgagcccataaaaaatccctggctccactggcagagagaagagaagcagctggatgttgaagactacagttggacgttggagagaagtggcttgagttcagagggacagtttgacggtgtagcttcagacaggagtttggccagggatggctggacttcaggggaagattaccttccatccccgtccccttttcagctccccttcctactgaaagccactttcattggcagtaaaatcctctgtatttaccatcttcagtttgtttgtgcgacctcatttctcctggacgccggacaagaacttgggtgccacaatgcaggtgtaaaatgctgtgtcacactgaccgcccccactgagctgttagcacttaaggcgtccatggatggcagagctaaaagagtactgtaacctgtcctcttgggcttcaggggttgcaggcactgctccagacgctgctgtggggctggtatggaattcgctccttccagcacccaaaaagcactcacctggctcctgcatctactcacctgcgtgctccacctccgtgaggggtggagtgcagcatgtcttcatgagtggagttcacccctgccagtgccagagtggctggcaagttccagcgcccatgcactccagttcccacccatgaagcgttcagggaaataatcctgcttcatcaccacaaacattgtggccataaacatccttgtgcatatttacttatgtgctggttccttaatttctgtggaagccaattcaatgccactttacttaccccagtccctattctcaaagaatataactttgtatattttagctttttcttctagcatatatatgtctctgcatttctaaataatgtatatactgttatcttttgtttcatcaattttatgtatatcttaaccttatattatagtagataaaaatttacctgtctgatatgatcatatccacagcttcctctcccctctttctcccagtgtagttatattacaatttgggggtaaatcagcccctagtgttttcactattttgtcaaaataaatggcattaacagctaaacctttaacaatgaagttaatatctgtctttttttcatgtccttaattgatctttgtacctggtacagacttttcctctatcttccataggctcacagtacctttttccacaaagctgatcacattagtaatctgtcagttctccttcttttcttggtgatatctctgctggagacctacattttccttctagctagacttctctctcggcctgctagatagctgacatcctgagatttgtcttcactgttattctagaacttccctttgccttttcttctgtgttggattctctctcttgttttaccccattgtttgaggaagcacagcctccagcagctatcagaattaaaacctggtgcagtggtaacagccttcatatgccttgctcttggtctgctggccctgtctggatgactggtcctgtggctgagccagtcatcatcctggggtatctcacttcagtgccgtcatccctctgttgtggtcctgtgttagttctcataaaactccctttacactctctcatttctgtggctcccagcttacagtagcctatggaaaatggatccctgagagacacattcacacttcacatgtctgaaattgtcttcattctgttgtgtcacatgatgacttgtctgtcttgtacgggaaaatccaggttaaaaaacagttttccccagaagtttgaagatattgctttattgcacgcaatctcccaatgttgctatcagaaagctgccactgttctgattcttgatgttctgtgccttaccttatttttcttttcccctggaacctctgatttttcctgtccccctatattctaaatttcacgatgactgttctaattgtgggtctgttttcacctgttgtactcagtgatcattgtggtctttcaatctgtcaagactgtgttctctctgtaagctgctctttctttccagaacttctattatttgggagttgaacttcctggacagttttgtgattttttcatattttctcacctgttttccatctctttatcttttttcactctttttgtacaatttctttaacttcaatttccaacccatctattgggttcatttctgttaccgtcttaagtttcctcttttcatctataaatagttttttaagcattctgttctgttttcaggatgtgtgtcattctcttagttttctgcatttttttttcttttcagaaattgtctttgcctctcctggtctctgtctcctccatgttgtctttttcagtctgtttgttttgaactctgtctttcctgtagagactttccttgcatgtcgggcagtcctgattgtctgaccatatttaagaatgaataacagatgtattgaaagctctgaggatgcgtgagggacttgtcaactctgagcatcactgtagaataaaatgtttctgtcataggttggagaactcctaatgctaacaactcctaaagtctcctaatgggaaaaccagggaatggtcagattctccagagaacactcttccagactcctggctgcaagatgccgccctgcctgtcccaggctgggagctgagatgaggaatgagactggagggttcagccttcagcatgcatatttccttttatttgatgtgtggcatctcccaattccaaaatcctctcccagagttcaaacctccagtattagcagttgtgataaaggctgctgcctagcagggtggattcaaggaaaggatccagggatctaactgattcttaaacagtttccctcacattcttctttatttattttttttttttgaaacggagtcttgctctgtcgcccaggctggagtgcagtgacgccatcttggctcactgcaagctccgcctcccgggttcacaccatgctcctgcctcagcctcccaagtagctgggactacaggtgcccgccaccacgcccggctaactttttctatttttagtagagacggggtttcacctgttagccaggatggtctcaatctcctgacctcgtgatccgcccacgttggcctcccaaagtgctgggattacaggcgtgagccaccacgccctgccctgttcttcttattttagtgactcatctcccttccgcacagttccagaggtcaccggtgctatctgttcctgagcctttggaggatccactggttgttcctaactttcctgctcctcactgaggattcagcttcctttgtctgttaattctatcactgcttctccatctgctttccgtcttctaaaatcttattactgttatttctaaaatcttgttacttgttaaacctacaacatactaaacaatcctggaattggttgtaaaagggtcatggattgccagagatcaaaaggtatttaaaatctcctctcctattgtcctggtggttttatgtcttttaaaaggtcatcttccctcgttacagtgacgtttcaggtgaaagccatattagatacagtgtgttcaattctccatttttgcttggaagtcctgtgttacattttggtttaattttctcaaggctgtcttccggttcactgatggcctgttttgtgttactctactgtctaacctttccattgagtgattactaggagttctactttattttttcaaatctgcttattctctttttttcatgtaatcctaattttctccttatggcttttagtctttatcactataatatttttaaacaatcttattttgtactccatttgagattgtatctttccagttcttaggatttaaagttttttttttccctttatcactgtccctcatggcagtttatttgtgtgtgtgttggggggtgatactggcagttcaacctcagatatttttccttttctttgtttcttttttctttctttctttcttttttctttttctttttttttttttttgaggtggagtctcacttagttgcccaggctggagtgcagtggtgcgatctcggctcactgaaacctctgcctcccaagttcagatattactcctgcctcagtctccctagtagctgagactacaggcatatgccagtatgcctggctaatttttgtattgaaatgggatttagccttgttggccaggctagttttgaactcctgacctcaagtgatctgcctgcctcagcctccaaaagtgctgggattacaggcatgtgctgccatgcccggcctcttttctataggaatcttgtgagtcctgagttgtgaaatcgtttctacatagtggacatatgtttgtcttttctggagatctaaggactttcaatgatcctagaactgtgtttgtattaatttattgtcatgggattcccctactcagatacacaggtagtataaattccgatcttacaactgaaagtggttcatgcttaaggttctgatttcccaaaggtgtcctgagctagggatacaagggaatgttctgctctttatctctgaggcagtgggcagagtgctttagtccaccttttcatggttagggtgactttttgaggctttgagatttaggaaaggggctcagttctggccccgctacctcatgcaagaccaaggtcatgtccctgcatgggcattagaatctcaccactattcccagggcttcgggagcatttgcgagagtctgaaacttccttgagcactgtgtagtcagccttacataaaagctctggcttcaattttatctttatttctggggcctctgtttctctcccttcctctatcccccttttccttccttttttccctttttttcccccaaacttaactctgtgatattttcttgggaatttcacatccttgtagtgggaagggacccatatgattaacctgttgtttgccattttgctgaaaatgaacactcacatctaattttgtgttaaacctggaacatactaaacaaacctggaattggttgtaaagggtcatgggttgccagagatcaaaaggcatttaaagatccgttgtccaaccctagcattttacttaaggaaactgagcctcaacactgataaaaccacttgcccacagacacgtggccagttagtggaaaaggtgggactgacctcaaagagtggtcacttttatctcacagcatcacaaggaggaacatctgacagcacttgccaggttatcaagacaccaagatccaatgcttgttgagccttaagtcactgagacattttggaaaagccacatataccatttgtgtttgtcttgacttgctgttgtgtttttctcttcttgaatacagagtagtaatgcttgttgaattatttaagtggcttattgctgtgccagtttgtttgtttttctacctttattttttcaaagaaaaacgcctttttttttttctccttgaagacatctttcaggatccatcacctaccggaaaccttccctgaagtctgaagctcttagagggtttttcaccttttctagctccttttgaaattgtcatttgaaccatgtcattagcaccatatgatgaattcatctgatcctctttaattgttgaatatgtatgtgcttcatctccccaagattgtaagtgctagcttgcagaaaccatggcttatatatctttaccattttccaaagtgttttcctgtggatgagttgatgacgaaaaacctagaggaaatatgttcttttagatagagcctgagtttggtgtcaggaagcctggattctgccccatttctctgctccctggtagacctatgcaaaccaccgatgttgtatggagaaactactggtgtctgacaatagcactgatacagtggttgtaaaatttttcatgcaagctgggacagttttcagagtgaaagggggcaatggtaataattgtgcagggacaacaggtataaattgggactttccctaacatgctgggacagacggtcaacttatgttctagatcaccttgagctcgtcagaactatttgcacagctgctcttgataccagtctttcaaacaaaaaattatcatcccttacaaaagttttcatccacgagcccaactttacaggtaataaaatttttagtttttccagacattcttgttttttcagctacttccatggctccaaatgcgcattataactgaagttaaactagattgtagatttgaagattagtactgctgagtaacaaatgccttcattcttctttatcaaccactctgtcttctggaaggaaataaaggccccgatttctggagttctgagcctacttttcttgggtgcattttgaaacatacggattttaccgctagtatattcagtgaggaaggaaggcttctgaaggattgatgatccccaaactggattatgtgttcatgataatggtgtatttggtggcctagcatagtgaggtgaggtaggtctttaaaatggctcattataaacatcattgttcctgagctcacttgcccttgcatctcctgccagagtgctttgtacatagtaggccctcatcaatgcttgtagattttaaattcggaggcacacttggaagacaatggtggctggtaaattaattatcagggttagcaacttcatttctgcttacgcttaaaaagtgctgcgtgaggaggctgagacaggagaattgcttgaaccagggaggcagaggttgcagtgagctgagattgtgccactgtgttctaccctgggcgacagagcgagaatccgtctcaaaaaaaaaaaaaaaaaaaaaaagttctgctgtggttgatacatggtgttggaatgcaaagaaaaatagagaagatccctgccctccagaactttgtgacctagaggcaactttagaaccataagccactaaaatttagaaagttcaggagaaaggacaatcacttttgacttggaggaatgaggtagcacttgagctaggtttgaaaaataagatttttctctaggactgaggtgagagaaggctgttccacatggtaggaacagcacaaacaaaaacctgcaagagtaaaattgcaagccatatttggagaatcagaaaaagcctggtatgttcagaagataagatttaatgatgttggtttggggaagttagaagtcctttaatgtcaaatgatggaactcaggttatgttatatagaaaatggagtcacataaagtgttggatgagtgcagtgatatcaaccaactcatgctttagaatgagaacctggttgcagggagaccagttaagaagaggcttaggtgttcaggagagatataaaggcaggagaagaaaaaggagccagaaatgagattcagaattggcagttgattgaaggaagggccaaggtggagagaacaaccaaacacaatcccaagggacagagtggatggggatgagtggagggggatgagtagatggggatgagtggaggatggggatgagtagagggggatgagtggaggatggagatgagtggaggatggggaggagtggaggatggggatgagtggagaatgggatgagtggaggatggggatgactggaggatggggatgagtggaggatgggatgagtggatgggatgagtggagggggatgagtggatggtggtggagagacacagagaggatcagaatttgattggccaagactctggatttccagggaggttgtggagagataagatgaaatagtatgtgaaagaactttgaacaatgctttgcataaaggagatattcaatgaacattaaattgaaagaaaaagggaaggaacgaaagaaaaaaaagaaagggaagaaggagcttttcccttctctctacctctctgctgtgccccagtagggagagacattgagggttttaggagatctggtgggcatttttcctgggctgttcctaccaatagacttgctgctggtttcatgttagttaggtggcacaccaagaggggactcagaaagaacagaagatcagaacttgctggtgtcagacagaaaagacatgagcttgagccacatttgaagaaagaaagagaattgggttgatgaaaaggccatactgagaattatgggagtagaagttgtgaaggcaagaaggaagacggaagaaaacacaccaccgatgcagagaaagagaaggatgctgactgaccttggaggcagtttctgcatgttctggggcctatctttctatccttccctctatccctcccttccttccttttttccattcttctatttttctgaactcaactctgtgacattttcttgggaatttcacatcttcgtagtacaaggaacccataggactaacctattgtttgccattttgcttaaagtgaacactcaacgtctaattttgtgttaaacctagaacgtagtaaacaaaacctggaattgattgtaaagggtcatggattgccagagatcaaaaggtttctaaagatcactttgtctaaccttagcattttacttaaggaaactgaggctcaacactgataaagccatttgcccacagacacgtggccagttagtggaaaagctgggactgaactcaaaggatggtcactcttatttcacaacatcataaggaggaggcctgtcatttggcggtcagcacttgccaggttgtcaagacaagatttgatgcttttgggaaatgtgggtgaactattggggatcattggaaggagaacgttgcttaccttctgaccagcctatcctgaaactctgttaggaaaaccctactactctatgaaaacaaacccagtttctcctcatttttttcctgaccattgggaataacagcaagacagtccttttagtgattagaaaccaagtcacattgactttttctgacaagccactccaggataactctcaataaattattttattggaagtactggctggtactttgccttacagaatgcctttcggtttctttgtcttgggctttgattatttggtaaacatttcagtttcatgatgacgtggtgtttagatggcaatgcatgaattgcattactaaaattgtttgccttcagttatattacatctgcttcaggaatgctagagaacataaacacagtttatttactaaactacctcagttggagcatctgagagagagaaagcataaaatctggtggttggcatggcgtctcatctcgagtcagagaatcttgaagctgggaggttcttttggaagcctcctgctgccgccttcttcaacgtgatgccaccatcctccccctgaatgtgtctaacaaaaggcagttctcagaatgtgccaactgttagaagaaggaaaaccacaattgaatagaaacttttaaattaatttatcctaacatggatcgtagatttgttatgttgactgcactgcaaaacgaatcaagccagaatcacattggaatctttttttggtgtgcaaaatcccagtgtttctttgaggcagtgctttcagtggtgcacgtctctcctgtgcagaggaaggctctttacatcatcttagcacagtgtcttccacttctgtggtttctatcacttctattgccttttcccttggtattgtacctttccttgatatgggttccaagatgtagctgtacttaaagacttgatggtaaaaataggccagtctctaaagcaattacagttctctgtaatttttggatcctatcaaccagctttgacatttggttgaatgtgtttttgcagacatcagtgtaaactttacagagggccactgagccttagcagttcttcctaagcaaagtttcactcattctttttttttttttttttagaaaacatttaaggcctcctatgttcctttcagtgttcgctgtttcttctttatctggggtccttactgactcaccttgacgttactgattcataaatggattttcatttcttttgctgggggtcagcactttgatgattatccacttccacttccactgtgttattttttacataatatttttgttctggttacaaaagcaagatagaatttttgcagaaaaatccggaaaatagagaaaagcaaacagaagaaaaaaaaatcactcataacccaccaccaaaaacaaacaaacaaacaaaaccacagccctattgttaatatgttgataggctcctgtctttgcctagcacttagaaccctcctagtcaggttctaaattaactttacaacctcatctccctgcttgcacctcctctggggacatacattgcctggcataagacttttcatatttctctctcaatgaattttttctgattatgtaaataattcatgtggttgtacatatttccaatagtacctataaggaaaataaagtaaaaattatttttaaaaacatttcaccttattaaaaaaaatctcaccaccctgaaataaaagccattgatattttggggaccatctcaccaccatgtgtttatgtcacctccacacacatgatttcccataaatgagataggagcacccatgcggttcttatcatggacacttgctttcatttttcacttatttacttttttcctctcattcccttccctccttccactctaattcctctcttctagattgccagtggcatcagccttgtctgtgtccttccatactttatgcttctacaatcttaccaaatgttttgtagtcacaaatatatgttgtgattgttttttatacaaatcagatcatatcatatgtccctttatgcatctttctttttctcatttaacagtgatagattgctgaaatccctcttttgttttttcatgactgcgtactattccttgattgactgtagcatgaattattgaatgtagctatgacaaataatactgtaataaacatttctgtgcttacaggacgtgagatgacttgattaagaaaagaatagatttttagattggaatagacatttccagattgctttctaaatggcatggtgattcgtatttctaccagcaagtctttctgtatcttgccaagggacgatgcctctaaattgcaagaaagggtgggatgccttgtccatttgaaatccaaaacatcaagacaaatatggggcaataatatgaccatcacaataatatatataaaagagaattcattaagggatgattatcgctttctagagttgggttctggggaagtattatttatagaaatgagccttaggaggccaggcacactggctcacgtctgtaatcccagcattttgggaggcagaggcaggtgggtcacttgaggtcaggagtttgagaccagcctggccaacatggtgaaaccccatttactaaaaatacaaaaattagctgggcatggtggcacatgcctgtagtcccagctacttggggggctgaggcatgagaaacacttgaaaccaggaggcggaggttgcagtgagccaagatcgtgccactccactccagcctgggtgacagagtgagcgtatgtctcaaaaatagataaataaataaataaataaataaaaaagaaaagaaatgagccttagggcccgaaatgtaattttatttttagcatgatttttttttttattacccgacagtttttgattagtgtggcagctagaaatttccctcctggtttaatttgcttctttatagtttttgtcaaaagctcaaatggtacaacacatcacaggtgacttttcaacatttgagtcaaccttgaaaatacacagatggatggatgtcagggtgagacctgacttcaagttcccatgaatgtggtttatattttaaacactttaaaaataactgtgtatgtcgtggtgtcaggagtcaggcaggtggaagggttaggccttccaggccatcttccgagctgcaccggacgtttgtctcacctcccctacagagatggtggcacagtccaatcccttttccctcctcactgggtgtcctcctccaattcatggattgtctgacactttctgcactcgtccctgctgctggtgtctgctggcacttcctgtccttcttgcttcccatcttccttgtctgttctgcccctctcccttccatttctcccgtatttcttagctttatcacaaaaaggcttgggcatcacagccatggcccactcttgagattgcatttcttggccagcaagcccacctggcctcatcattttggctgcaacttcaaggtcatcagcccatcttagctctgttcatccctaagttttctgtggataggctttctatttgacagagtgcttctcccagccccctcttaatttctttatctgacactgttttttgggacctagaggtccctgagggcctggggcttccttgtgcgttgaggtgggccctgtagattctgccgtcgagagaactctgaccagcccgctctgagaaagaatgtcaagtggtcagggtctcaccaagcaaagggcctctatatgataatggtccacagagctgtcaggagaacaaatggggtaatctggagtgtgatttcatcattcttcagtgcattctcagtgccgggaaaagtcatgagtagggttctcgttttaactcctaaattatgaacttactcacatttgtggattagacaatgcctcaacatcattttcatagtgtgtgtgtgtgtgtgtgtgtgtgtgtgtgtttatgtgtgtgtgtgtgtgtggtttaatgtgtacaactcatctgaacccagttgctctgtggtttatcttttactgagaactgctttttttcttccttttctaagaaaatactagttcttaaagtatgaagtctttcttgtgagttcatcagcagtgaggggtgtggtgtgaggacctacattggtgataatgagatccaacaatcactgaattcaggcgattttgacacaaatcatattgactaaaataatattaagcacgtgatgctggtgacatttgaatatttgccaggaagaatacctgcatggtaacaattggctgcaaatggaagagatttgcatgttttattgtttttacagttttaacatacatttttattggagaatctgaaaccaacctatgtaggggaggttatgggagcaaaagtaacacagagaaccagcaggaatcggcctacctgcctgcctctgtcctcctctgctcctaagaatttgggtcacctctggcttcagcacttagtcctaatcatgaacaacacatgagttaggggaaaggtgtattcacaaatttgaaatttctttatgtttttcctctctcacattcctttcctgcagtctctttcctactttttcatcctttgtgtaaaggtagcaactttttttttgttttttgagacagagtctcgctccgttgcccaggctggagtgcagcagtgtgatctcggctcactgcaacctccgccttctgggttcaagtgattctcctgcctcagcctcctgagtaactgggactacaggcatgtgccactgtgactggctaattttttatatttttagtagagacaggatttcaccatgttggccaggctgctctcgaactcctgacctcgtgatccgcccgcctggatctcccaaagtgctgggattacagttgtgagccaccgcacccggccaaggtagcaacttttatttgagaaagcttggaatcctgacctaagctccctgagttcccactgtggcttgtggccacctattgtgatactcactctctacccttggttttctgatctctaaaatgagactgtctacttcacgtggctgttaaatgcatcataatttccttccttacctcccttctttaaaggaaacttggaattttcaaagctactaaatggagtttttttgtgttttttttgttgttgttgtttgtttgtttgtttgagacagagtctcgctctgtcgcccaggctggagtgcagtggcatgctcttggctcactgcaacctctgcctcctgggttcaagcaattctgtctcgcctcagcctcccgagtagctgggactacaggcgcccgccaccacgcccagctaatttttgtatttttagtagagacggggtttcaccatgttggccaggatggtctcgaactcctgaccttgtgatccacctgcctcagcctcccaaagtgctgggattacaggcgtgagccaccacacctgacctaaatggagtatttttagggccacatggttaggggcaactaaaaatgtcatatgctaccattgcattcatgaacaccatcctccctcagagaagaaaggagtcacatgactgcatttctggcgaaacctgattgcattttggtaaaacctgtgccaggaccaggacagtcatcaatgacgtgttccctgattttcatgactgaagagcttcaggctggtgctgccgcaggggacctttgcgtggcatggctcctctgcactggcgttagctgtggtgagacacagcttgcagccacagtaggacaatgccaagtccaatggtatttgctgttcaggagcaaaagaactacacagcaacaacacatactatcgtcgagtacctatttatttcactgtatgtgtctgaaggactaaatcgaagccagagccccccgcccatgcaccaaaataaaatgcagacagtgttgagttaccaaaatgacagtgcacctgcaaagggaagtcagtgaaggtttaaaggtgaagacttaaaaatatatagatagcttaaaactgcaaataaaaaaatgtcacatagagattttcatgagcttagaaaaccaggaggagatttgagtcgagagaaaacaaggccagcctctctcaagtggcagatttctgcagtctttggaaagatggaaataaatatggccaggcgcggtgggtcacacctggaatcccagcaccttgggaggctgagacaggcaggtcacttgaggtcaggagtttgagaccagcctggccaacatagtgaaatcccgtctctactgaaaatacaaaaattagctgggtgtggtgatgcccacctgtagtcccagctactcgggagaatcgctggaacccaggaggtggtggttgcagtgagccaagatcgcaccactgcactccagcctgggtgacagagtgagactctgtctcaaaaaaaaaaaaaaaaaaaaaaaaagaaatgaaaagaaaaagatgggaagaaataaaagctgcaaaaggacaaatggacagattcagggcggaaagcaaggacagagcaggatttgagcgtgagacttgctatttgggcttaggtgaaatgaaataaagaaaagggctggagaagtcagaagtgggtcacagaacaatgagatggtgaatggggtccaaagtgtgggtcgccaggactgccaggaggagccacatctccagggtagggctaagctgcaagcaaccagcattatttagcagagtcctgcagaagtgaatggaaagatctttaaaaaacctatgaatggcagtggaaaaaaaagaactgaaaggaaagcagaaggcttatgggctagataaactcattctcagacatatgactgaactgaaactcagataaaatattatcttttcatccagcgtctttcattcgttagaagttcagtttctttatatttcattcatacaagagcaatgcagatttttaaattaatatatgtgctcatagacatgtggatagaaactcattgctgattagaatattatgaattaaggaaattttaacaaaatatacttggaaagtataatatgggattgaaatttgaagccaatgataagattataaagactcagagctaatctttcatgcactattttgtaaagaataaaatattattcttccttgggcctgaagtccacactagccccctcactaagatgataaccacaggggtgagccctgagatcttccacccccaaggcctccactaatcgccatctggacatttgcttttcgtcccttgtactgcctgttctccacctgaacagtccagacacttccagcatgttcactgcccacaagtttacttaggaccccgaagtcctagaaaaaagttgcctttagcttggctgctcctttggtctgcactgtgtctcctccccatgtctttagcttcctcaagctggatggtttcttcctgactgcacagcttcactcccaactgtccctactgccaccctccaccacaccaggggctcttcttttcccaggtttttaaggaaacactgtctttgaggggatcatgcaccaatttcagcaggtgtctggagccataacattttactttcctgtagcagttggaaagatctctctttaaacactagaccctcttgatcctgttaaacggcctgattcttccttctgtcttggtgaccagtcatctctgtccaacatgccagcttctctgtcttcccccactcaggtaaattcagacatttgccccagcctaggtcttagcttcctcgctctgtttcctctgtctcggagatctcacctactctctctaatccttccaattttaatgcaggttgttccaaaacccatatctccaggcctgacacgtctcccatttccatcctgtatgtccatgccaccttggagaatcccccaccatttcaaaccaagctctgcctctccctccgccactaacagtgtattgggtacagtgtattgggttgaggatttatacacttctccctagcattgccagttaggagaccacctgccaatgggaaccactagtcctggctccccacatcttagtcatcttcagttccatcatctcactttctttgtatccgtacacagactaacacttcatttcccccacttccaaccctgtcctcatggcgttcctagaaatgacataggcggacatctactaaacccttacttggtctgtataagtggaggagttctaggtgaagggaacaaaagcccaacttgcaccctgaaaacagagagtcacggcccctcgatcaattcacacacttgcaccaatttaccgacccagaagcccttgaatgaagaggaggccgggtctccttgacgaaggaccctaccacactgtcaagaattaatactgttgctttttctcccagccttccccaaagggacctatagccttttgccagggtgactgtgcactggggaaaaggaattaatcagaccttttggggactactggtgactggctctgagctgacactaattccaggagaccccaaacatcactgtggtccagcagtcagagcagtggcacgtggaggtcaggtgatctctggagttttcacttcatgtttgtgtccatccccatagcactttgttcaggacaacgtggcagggcccacactgctgcagtggattcctggaggcttgtacctcccaacccccaacccagagctgcctacagccacagtattattcagtccaaagcacctctgtgacaattatattcctggctctaaacttccactggtgcccagttgttaggaacaatgcagctttccttagcccgatagttaaaacccttcacaaagtctccttcccctttatttccagttttcctggctataaatcctcaacccaatacactgtaccccactccccccagcccccagatacaccatcccccaacacgaaacacttaccctcttctcagctttgcctttatccacgctgttccctctgcctggtatttccttttggctcctttctctggatttgtgtggtgcctgttttagcacaaatataccatgtccccttgtaaaatgtcttttcttcacttcagctggtaacagccagggaaatgagcaaaaacgtgtggatagattaattcaccagcatcggggagccgggtgggcgggggtggggggtacagtgtggcgcagggcatgtctttctgtgggtaggtcgttaacaattttcataaacaaaagattgccttgtttatacctgttcatcagagtcagcatttcttaaatctgtttaaggtgaaagtgagtgctttgtgttttaaaaatcatatgggaagcacagaaataggaaatgttcactttgtttaatgtggaagtatattccataacaggtggcctctcaacttgcacaaataaaacaaaattggttggctaaaatctatcagagaagaagaggaagtaatcgccaggtggtaggaccaggagcagatggggactatttacttagatcctcaattcttcttgttgagtgtccctctaattaagtacctttccttagatgttaaataaactttcatatttttaaatagtattttttttagaaaagtgtattcccatgccagtttctccttcttccaaagtcaggggtagaataaccatatagcattaatagagtctgtgtaagcttaaatagtccaactttcctttcaggctttttatttgaagtttccaaattacacagctaaaataaaaacagcacagaatttaaattgagaccattatatatcgcagggacttcccccacccccatattaagtaaggcagtgtcagccctggtggtccgtgcagactcagtgcactggaggcagaagttccaggtggactgactcctgcccccacccagacctctggtgctcccaggcagtctggaacaatcagactctggtgctcccaggcagtctggaacaatcagactctggtgctcccaggcagtctggaacaatcagagttgcccttggtcttccggaaatactgtaattccctgtgcaatgttagctcttgaccatctttgaattctttttcttagacttacaaggctctgtcgctggtttccctctcactcttctgacgactacatttcaacttccttcaacaaacacttatgaagcatttatatagcacttactgacggccacagccaggtgcagttttgtggatctgtacacaaatgaattagatgagccggtgcccatcggccctggggttcacagaccaaggctcgctctgccggcatcctgggctccctcctgccgcctgcacctggaacgcttggcggtctccgtgcctcttctccagttctctcctccactgtgctcctttggaaaggcttttctgtcacggcttcaatcataaaactgtattcctagtcctatttcctcatctgaggtgaagcatgaaatctcctcttgtttaccccgaattcagccagctcaccacgagccctctctgcatctgtcagcctctgtcagcagctgtaaaagcttcccttctccccagacccccacatctggaaaccgtctttaagtcgtcctcccctttttactgtgtgtccaggaatccacttttgggcttcctctgaccggcctcttccttccttcttttcctcctccccgccccactgcctccacctactctagtcccaaggccgtgcccctgccccaaccctcccactgtgctcttcccacccacaccagagtccccttctttaaatcctgtccgatcagtgtcactctcattaagtgacagagatgatgtctccaccttttatatctccaacagcatctaacccaacacctggcacttactagaggcatcaacgatgcttgttgttctgtgtggcgaaggcacacctggattctggatggtcagtctcagctctccatctttgctgcctcacagggactccaaatgtggagcgtctcccactgcccttaattagggaaattcagcctcgcagaagacagtgaaactgatgaaagcattgggaaatggaacctaggaaagttaaagaattggcatcatttgatgtgagaaagagaagcgaagatgatgagagatcctagggaaaaggctacatgccctgtctttcttgagacaagcgtgtgcacttcctttgcttccactcttacttgtgtttatccttggagggacctttaattatctaacgcttgggtattggccacggtgcttatcgtctgcgtgtgaatctggacatggtccccaagctgtgtggtgctgtttgttggtgcggtccaggatgcacagggctgagatggtgctgcatgcacacttaccgagcacatccccctgggagaggtgtggacaccaccgtgaagggggcccagacctcctccttaaatgcctgcactttcacagggatcagacatggagacaagaactctcagaagagggagaggcctgaggcacagcaggaaggtacaagttcaaaggaagtgaagatttccagtgagagctatcagactcttgaaatggactacagggaaagcctgtggtctcctctttcttagaaatgctaaactcataacagaaaacctctccaccgtggcttgagtgtcaaattctctggaggcctggggatggggccgggagttttctgcctctatatccccatggtccacttattcgggtggcttagtttgctttgcaagcagggggtgggagcggggctgcttattccaaccacagtagtcaaatgtgttacttatgagaaataataaaagatccttcttcttttctttttctagaccccctctagtcaaatgttgttgtttttttaaatagaggaggttgttttgcatttttcttttcgtagtgttcgaatttagcttttgtatatactctccccagtagttcagagtacattcatgagcccagatcatgaggaatgctcaccattttcctgaaagatggtgtgtggaggatgtgtacagatagaagctaggctgttgaagattttattgaactcatcagcattaacaacagacactgttagtgaggtccgaatgtttttgtttatttttttgactcaacaaacagttattgagcaaggctttcttctgtgcccggcaagatgcttgccacttgctgaagagacaaagatgcatgagatatggtccctgcttttaaagcacttacaatctagcagggaagacagccaggtgtacaaataatcatatgtgttacaaagaaacgattattccggttcaaaggaaggctgttgttgatgaaggatggttgcatagcagaattataatcgtcagtttgaaattcaactttttcaagctttgtcatttctatcttgtattagccttatttttccctttttcaaaatacttatttgcataggtattagtcacatggttcctatactggaacagtttagaaaggtgtttattggaaagtctcgctagcacctccgtccccatccacccaattcactactcgctcttccatcagaataaggaaccattgtctattaatttcttgagtatatatccagcgcccatccatgcaaaataacatatacacattttaaaattttccctttcttacacaaaaggcagcttactgtttgccctgttaatttaacagtatatcttgagattttaccatgtaagatcttatcatggtacatcttgagatgtaccatgtcagtacatagaatgcatgcttttcctttcttcctaggtagtataatacttcctagtattgcatcgttttggagatatcagagtgtgccagttatcaattagctgcataacagattactccataacatagtggtttaaaacaacaacccttttattagtcataattctatgggtgaactatttggcctgagatctgccaagggttttttactgctgcttttgcctggatttgttcatatggatgtgattatttggggctagatggtctaagatggcctcactagcaggttgttgggagagtctgacctcagttggaatatgtgccttgagtaaaccagccccagctgcttcatatggcgactgggtcccacaaaaacagagaggggttggccccgctgtggaggttttattaagcttctacttgaatcccattggttaatgttccattggcaaaagcaggtcatggggccaagcccagagtcaatgtggaagcaatttcaggatgagaaattcattagatgtcattatgtaactatttactacccatggagtaattaaccagcccctgatgatggacacctgtttatttccagtcttttggtattgcagataatgctccaatagataatcttgtatattagtcagttcatatgtgagcagggtaagtaccagaagtagtactgaccctgtgctggatagagggcagatgccttctcaattatctatctatcctatttctgtggtgctgtttctctagatattttaagcttgtgtttttctgtcactcgtgcaggagctttgaaaatgtgaaaagactttagataggaaatgcatataaactgaattaattagaaactcactcctaaaataacaaaaaacatgaaagctagaatagaaatcaaataattttgagtaaagtaatgtgtacattatttgaagaaatacaagtatgtctgttataacaatactttacatttctgttgtgtttacagcatagaaacacttagtttgcttttagtatctcaattctcagaacaattctatgagttgaaagtataattggccccattatgtgtgtgtatgtgtgtgtgtgtgtgcgtgtgcatatgtatgaatgtatttaaaggcttagagaagttacctaacttgccccaactaacaagtaatagccagaatatatacccagccctgtgacaataaacttgacgttgtcccattaatcgcatcttactagtagggacttgtatcttgtatctggcttagcttctaaagatatacatgtgctcaacttgctaattgctttgctagtacaatcacaatcatatatgatatcacctcaggaggctctttttaaaaatatataagtagttaatttctaatttctgaataggtggggaacctccctgaagttttctcttgttttacacatgtcattggcatccaggttgagagctccatctcctgatcatagcctctagtaaatcttgacggaggaattctctttaagcccagggtcttgctttcagacttcagaaaagaggagtttttttaaataaaaccttgtctggccctcccgcaatggatgcagaaggtagactgttttctttcttttaattcacactcagacgttttcgtaaggggcttggtcctggcaaagtgggcctcacatacaaaccacccactttcctgaagcgtgattgattagcaaagctgttctgctcaagggcagcctgttttccccagcctggatgctgacaggtccgacatgcacagattttcaagcaggtcgccagtccccaggctgcaggctgtaggccaggacgcttgttcttgagggagaagagaggagaagaaatccactccgggggcaagaattaagctatattatagaattcccaagacacagcagggcaggccaacatagtccttgtttagagagcccctgatggtgttgggtgccaagaaaaccatggctgcacaagacacacagagtgaaggtgaatataaagatgtttaggcaaagcctgtgcatatggtactgatccccatttgtctaagaacctctaaacatcaaagagagttaaagaaagatagaaatttgatgcctaatcaaagtagcctatgatggaagtttggaaatacagccaagcaataatactgtaaacagaacgaggtacagatcatgtctttgcatgtttgtctctgtggcatctaacagcgtgtcttttacaagtagaatctgcataaatatatagtcacaaaatgttagagctgaaaattatcttacaaaccgtcttgtccaggcctcaccattttaggaatgagttaacagaggtacagacaggttaggtaagtggcctcagttgttctgagtcagaccaggtcttctaaatcttagtgaagtagttgtcataaaattgtgctgccagtattctaacaaatgttatgtgaatgtaggaatattttattttttttgagactgagtcttgctctgtcgcccaggctggagtgcagtggcccgatctcgtctcactgcaacctccgcctcctgagttcaagtgattctcctgcctcaggcacccaagtacctgggattacaggcatgcaccaccatgcctggctaatttttgtatttttagtagagacagggtttcaccatgttcgccaggctggtcagaaactcctgacctcaagtgatccgcctgcttcggcctctccaagtgctgggattacaggcatgagacactgtgcccagccaaaggaatacatttatttcctttttttcattgtagaatttattattattattatactttaatttctggggtacatgtgcagaacgtgcaggcttcttacataggtatacacgtgccatggtggtttgctgcactcatcaccctgtcacatacattaggtatttctcctaatgctatccctcccctagacccccaccccctaacaggccccagtgtgtgatgttctcctccctaggttcatgttgttctcattgttcaactcctacttacgagtgagaacatgtggtgttaggttttctgttcttgtgatagtttgctgagaatgatggtttccagtttcattcatgttcctgcaaaggacatgaactcatccttttttagagctgcatagtattccatggtgtatatgtgccacagtttctttatccagtctattattgatggacatttgggttggttccaagtcgtcgctattgtgaatagtgccacaacaaacatacatgtgcataaatccttctactatgaagacacatttatttcctttttaaagagatttatttaagagtcactgattccgtaaaatcatggaaagtcatctccttaatttacttatgtattaaccaaaggagattcccccaaggtactttctattaggggcggtgggaaaagggagggttataaggatgaattgactagcgtcttttgaaagactttcaggaatttgggtcttaagacattttggccatcttacagaaagtcttaaatgtcagaattgggtgaaaaaaatttaacttttctcacaatggtttgttatatgctcaaggtgcagatagcttggtagggacaattcagcctgcggttaagagtggtctctatgtgtacgtcagtaaactggctatcagcgtagcagcaggagcagaaatcatcaagaccgtggaccccccagcctgtcacttgacttctgctccgtaatgctgcctgcacattgcccatttggtgcaggttatgcctggcttgtttcaaacatcccgtgcctgctggagctgaggatgcagcggattcattagctccataggaatggaccccttcattcaaagctcaatttggcccaggcgcagtggctcatgcctgtatctcagcactttggaaggctgaggtgggaggatcacttgagcccaggagttcaagaccagcctaggcaacctagcgagaccccatctctataaaaatattaaaaaattaaccaggcgtgtcccagctatttgggaaactgaggtgggagaatcactttttcccaggagttgatgagttttctcccacccgtgttgagctatgttgcaccattgcactccagcctgagtgatagagcaagaccctggctctaaaagaaaacaaaacaaaaaataaagcttgatttgttttcccatcccatggcccactgccaactctatcatttttggctcttgactgtcttatacgcgggagtgtagggagaaacttttgccagtcccttcaaagatggctttgacaatctgttgtcctgaataaatttgaacacctgacaaaagagtgtctagaatcttcctttcctttacaaagtgtaaggggtcagatgtattgccccttttgggatataaatcagttattgttctgccagccactgggaacattttagaagcccatttattactatctgcaatggtacctcatatttggtttcctgtgtcataaagaaaaacctgcaaatacctaaaagtaaggattccagtgaaatgtgggttctgcttcactctgtttggtgtgggaggctgtgtaagtctaactctaagaataccggtagtggtatctatcttcattctaagaactgagggaggcgaggtttgtgcagaattaaatcaccctgtcatatctgtgagggcttcctgcagaacgaaggcaagtaaacccaaacaaacaaaacaggaacatgttggaaacagtcagaggtatacgtctggaactaaggttacgagctgagccttgaaaagttcatgagagactggcttgcttgaaaatatccttcgtgtgtgtgtgtgtgcgtgtgtgtgtgtgcatgtgtgcgcgttgttttgtttgttacggttttggtccgtgctaccgtatttaccccatgtgtggtggttggaaatgtcagggtttcttgattgaaaaaggaaataagagattatgccactcacagcacagaagtgggatgagcctcactatggtgtatacgtgtgcgtctgtgtgtttatgtctgtgtcatctccatgtgtttctgtgccagtgtctgtgtgtctgtgcatatgtagtgtgtctgcgtgtctgtacctgtgtgtatgtctgtgtacatgtgtctgcgtgtatgtgtgtgtctctgtgtatgtgtctgtgcatgtgttgtatgtgtgtctatgttgtgtctgtatctgtgtgtgtgttgtgtggtatctgtgtgtgtgggtctgtgcatgtgtctgtgtgttgtgtgtgtctctgtgtctgtgtatgcatgtgtctctgtgtgtgttgtctatgtgcatttgtctgcgtgtgtctctgtgtatgtgcctatgttgtgtagtgtttgtatgtttatggctgtgtgtgttgtgtgtgtctatgcatgtctgtgtgtgttgtgtgtgtctctgtgtctgtgtgcctgtgtgtcttgtgtgtgcatgttgtgtagtatatgtgtgtgtctctgtgtctgtgcatgtgtctgtgtgtgttgtgtgtgtgcatttgtctgtgtgtttctgtgtgcatgtgttgtgtagtgtgtgtgttgtgtgtgtctgtgtgttgtgcgtgtctgtgtatgtgtctatgtgatgtgtgtggtgtgtgtgtctgcgtctctgtgtctgtgcctgtacatgggtctgtgtgtgtgttgtgtgtgtgcatttgtgtgtctctatgtgtgcatgtgttgtgtagtgtgtgtgtcttttgtatgtctgtgtctgtatgtcagtgtgtgtctgtgtgtgtctgtgtatgtctgtgggtgtctctgtgtctgtgtgtcagtgtgtgtctgtgtgtgtctctgtgtcagtgtgtgtctctgtgtctgtgtgtgtctgtatatgtctgtgtgtgtgtctctgtgtctgtgtgtcactgtgtgtctttgtgtgtgtctctgtgtctatgtgtgtctgtgtatgtctgtgtgtctgtgtgtctctgtgtcagtgtgtgtctgtgtctctgtgtctgtgtgtctctgtgtcagtgtgtgtctgtgtgtgtccctgtgtctgtgtgtgtctgtgtgtgtgtgtctctgtgtgtcagtgtgtgtgtctgtgtctgttgtgtctttgtgtctgtgtgtgtctgtgtatgtctgtgtgtgtgtctctgtgtctgtgtgtcagtgtgtgtctgtgtgtgtgtctctgtgtctatgtgtctgtgtgtcaatgtgtgtctgtgtctatgtgtgtctgtgtgtcaatgtgtgtctgtgtctatgtgtgtctgtgtgtcaatgtgtgtctgtgtgtgtctctgtcagtgtgtgtctgtgtgtgtctctgtgtctgtgtgtcagtgtgtgtctgtgtgtgtctctgtgtctatgtgtgtctgtgtgtcaatgggtgtctgtgtgtgtctatgtcagtgtgtgtctgtgtgtgtctctgtgtctgtgtgtgtgtctctgtgtctgtgtcagtgtgtgtctgtgtgtgtctctgtgtctatgtgtgtctctgtgtcagtgtgtgtctgtgtgtgtgtctctatgtcagtgtgtgtctgtgtgtgtttgtgtgtgtctgtgtgtgtctctgtgtgtgtgtgtgtgtgtatgtctgtgtgtgtgtgtctctacatctttgcgtatacaggggcatagcatagtcatgcaaaaccgtcttccttcaactcatagttctctccttcctcaaccagaagccactctgctttgttgtgaaaacaaataaactactttcttacaaaagaaagaccaaataacctgaaaagctcaaataaaatccaccttatgatacaatattaagaaacagaaattttcaatggagaaaatcccacaccagactgaggaagacagatcagtttaactggagtctctgtttgttttatatttcttttctactctccactcccatttgccaacaaaactatgctctctcacaggggacaggttcacccctcaatgtctgactaacatgcttttcatttgaattcaaaatatttggtgacgattggcaaagaatgaggatgggaaattgaatattacatcatcttatgaaagcttcctcctccctcacttccttcttcctttcttcctcctttctctccctttttccctccctcctttcctctctcccttcccttttctgttcctgctgtgaccgttcccctgattgagcagacgtggacatgggggagtcaactgtaggagtgactggcgcctcacagacaccgtcctctgaggtagctgtcaccagaggattgtcactgaaaatgcaagaagagtttggcatttgattgcattctgcacaattcaagcaggacaaattgctgcagaagatgacaccagaaatagccaccatgtagtgggttctcaccacatgacagacacggtgctgctataagcttgtgacttgcactgtctgagccctgaacacctgtagcaggtacgagcatttgctccattttcagaccaggagacagcagctcaaagaaagtgaacgatttgtcagtggtcacacagctaggaagtggcagggggcgcttagccgggttggactctgaaggtcatgcagcatctttacacagacccaaacccttcaaatcgatttccacccatgtgtgtttggcagccacatgtcaacaagccataactttcttacctatttcgggaaaacattattttctctcacctgtatttatcgtcatcctatttctgttgcaagaaatcaaaacgtgaagaagatagatttgaagaagacctttttttggctacttctgatgatgagatgcagttaggaagatggagttcagatgctaaaatattggaatttctgattgatgcatattcatggttagagggaaagtaagttgcactgtggagttaagaaatctgagaaatacaggaaatccaagctgagaaaaactcataactatgatgtttccatgtgcaggaaacttcaggtccttctgcgcccaaccttcctggaaagcttttatttaaaaaagtttttaaaatttttatttagttatttttaattgacaaacaaaaattgtatataaaggcttttgtattttatcccgtatgataaagggccgcacggttctttcttgatgcctgagttaagtgagcatattaacagcatgcagcgttcagctctcattaattttcaataggctcatttacctttgacccttttatttcaaagccaaaaaaaagaccatacatagagagaaacgattgcattatagctcctccttcaatatgagtcgctcaatctctaatggtttctttccatcgagaagaaggttttagtaaccaagtgactaagttacctagctaaactcccccctccttctttatcaatacttaattagtattgatgcttttcttggctaaatctcatttcagagcctgcacaactgaactttttccataaatgaaccttttaaaatgtgtatttgaaatatctttcagcctaagaaaatagtttttaacaagttatgcattgatttcctcttactctgaaatatttctcaagtgatttttcctgaaagattctttgtggttcattgaacacaaaaaacaaaccgtgtaccaggtctggtagaggttacagggatacagataacttggcatttgttcccaaggagcttaggtctccaagaggaaataagacacttcgacaaatagccacaaggtaaaatagagaattgtccagtgctgtaatttaactgctgattccgctgtacctaaaagctggttaaattatagttttattgaatgctaacaaactcttattcccctcctgcatggaattttaaaaaccttttattttctctgggctataattatggtgaccacattttccatggcaaaaattaagacacgtcgtctgacaaaggattcttgtgccacttctaggtgtgagaccacccatacttagattttttttaaagcaggcttttttaggcaggccctataaaaatagaggtttgttaaataggtgtgtttttagacttttcattaaaagcctacaatacaaacagtattttattttgtatctgaatcaacatgttatatcctaaagcactattttacagcctaagggtgtgtgttagtctattcataaaaacatactgctgcatagagcaataatacctgccattatctaggtgtaataaaaaggtcccaagtggtcctctccaggtctttaattttccttttgaagataaagctccttctttcactttcatggttcaagatttttggaccttgcaagtgattgctattgaagtgtgccagatgtgagcagttgtgagcatagtactttaaaagaaggtgaaggagtgactttttcttccttattgtctcccctactaccatctgtagtttctacacatgtaacttttccaaaacagcaaggcatgggaagggataccagccagggccgccacagtccaggcatgggacttctgaagtgaggagatagagatgaaagcggcctgtattgataaatgacagatgatgaaaccaaggcctgctggaccaagattcaatgacttacccaaagctacacagcttgttggtggcagagttagctcccaatccccagctttgtgagcaagggaggtttccatccccactatgatgttttcttggtgttctggggtcactctggtcgatttccatccactgtgatgttgggtatgccccctccatgtgactacataattctagaatcataattctaaaatgatatatcactgcactatcatgggaaaataagctggaagagctggagaggcgatgcctgccaccactggctcttctatagaggtgaccttgcaggttaccaggacttccccaggccgactctcagatcctgaagctgagtccaaggcaagccttatacgccatggttcctgctctcctgggtatcactgacctactgctgatccaggaacccttgggatcagacttttcccattaatgctttgtttatggttaaaatatcacagagtttagtgggaccactgctgtctttattagatggtttttatacttaattattttgtaacatggctgcacttgtaagttatctgctgatttttttgtagttcataagcataatgattgggtattcatagtcatatgtgagatgtgccaacctcaatctctatgctacagtatagagtatactataataatcactatattattacagcctggccaacatggtgaaatcccgtctctactaaaaatacaaaaattagctgggcgtggtagcgcacgcctgtaatcccagctactagggagactgaggcaggagaattgcttgaatcctgtggggcagaggttgcagtgagccgagatcatgccactgcactccagcctggacaatagagtgagactccatctcaaaaaaaaaaaaagaaaaaagtttaaaaatgtatctcttccattaaaaacatatccaataattctgctaagatatttgactgaccttcacattcagcctcattccagtgtaacttcccattcattcatttcattcaatggctatttattgagcacctactatctggcagacacttttctgcttcagcatcaaacaaatagacaaaaattccagcctgtttgtggtttatatgggattggatggtgctaataactgtatcgaaaaataaaaactattagcttgccaaaaatttggattactgtgggagcagagagctaaaggaaaagggaactcatatgtattgaatatcagtgactatgtcatatgctgtgttgtgtggtttatctcatttaatcatcacagcagccctgtgaaagatgaatatgattatttttattttttacagatgaagaaccaagatttaggaatataatatatcttgcttaaggtcatactagtgaggaaataaatctacatcagtcttttcaataccatgctagatgtgatgatatcattttagaaccatatgtttgatatatggaccaccatactgaaacctcagggcacatttttgtccactaataatatatatcaaggaatgtcatttcacagatgcatggatacggaaaatgtgtgtgtgtgtgtatatatatgtatgtgtatatatatgtgtgtgtgtatttgtatgtgtgtgtgtgtatacacacacacacacacacacacacacacatacatactactccgccttaagaatattttcatatgcaactacatggatgattcttgaggacatcatgctcagtgaaataaaccagtcacagaaggacaaatactgcatgattccacttatatgagcatctacagtagccaaattcacagaagccgagaacacagtggtggttgtcagggcctaggggaagagagaaatggggagttgcccttcaacaggaataaagaataagcaaatctcatgttaagagttcttaacacacacactcacacacagacacacacaaatgtcactttaatggacatgtttaaaacatcatttgaaatgtagttgttaagttcatgttctccttatcatttttgtagattgatcctcatttctgaatagcagtaatcactacagtacactctcctttcataacaggcatcttccatggaataccttgccccagattagcaatttgatgaccacagtaacatgtgcttctcagataacacatgacctttcatttggctgagaactcagcggttgactttgctaaaaataggtctttaatggttgagtgtgacatttcatcacggggtgttatttgggagtttttctcttcatacatgaaacaagtatggctgtagaattgattacccttgtttccttgatgaaacgcattcagaatttcaaagatattgaaaatatttttggccaaaattagttacacagaagtatggaatctgtcagtgcttggggacaaaacccttctgtgtattgaaaatgcagaagtagacagggaagcatttctggggaggagtgagaagctgtattaagtctggatgctggggcaggggtgaaggaggaggtcttgatgatgtaggtcttgaccaggttggagctgatgcaatggcaagtgctgtggccgtggtatcccctggtgatgtcattccaaggagccagctgccatcagtgctttcaagagtctggctctttgggtgaggggcaccaagggatagacgtgcacctcaggacacctgccatcttgttggccatctctctagtttggggtctttgtggaaaagatgtatgggccatgctttttagcttgtcttatcaccccaaatacttcccgtcatcctagaataatatccaggctctcgatctgatttccaaaatcttacactgccttcgcactgattctcaagcctcagctctcaccaactgcacactcccccattgcttgtgggccactcgaactgacttcctgatcctccaaacacatcaggttgctccctccttgggatcttccactacttgtgacttctgcctacattgtactgcccctaactttcccagggctggctccttcttgcctttcaaatctcagcttaaatgtcacttcctttgagaggctcccctggaacacccaatcattccctctcctatcaccctactttaattctctgaatatttctatacagtcaatgctgtgcttgtttattctttgagatccatgaaagcagggaccatgcctgtcatagtcccgacagtgctcccaagccctaggtgagcaccctgcacatagtagttcaatgagtagtttgtcaaatgaaggaaggaggcactcaggctgtagatgatttaaatgtaacaaacgtatttgtaggttattttttaataatgcaaaagaaatgaagactaggccaattttcttttttaatttcatatttcagcctcaacgcttagttatttctgattggtcagagattaattaatcacatgcaacagtctgtcctgagggggttcaaatgcactgctttttccagtgatttgcaaatgcaccggcctaaaacctactctctggcacagatttcagaatctccacttaacacatcagaaacctttagggcttatcctgaactccaaggctggcttaacttcttcagtaagcagctgcttatgcatggatgcctacaatgagtgatttcaccagaaacccacctcagctacttaaagtgtgatgtatttcatacacacaaagtgttttttcatatgagtaggttagtgacactactgaatacaaattaactgtttttgaatatactggaatctcacaaagttttttctgcctcagaagtggaattcagttgaagatgggtctgtccttagaagaccaagttattatagttgctaaaataaaaataaataaaataaagacttcaaaaaacaacagatgctggcaaggctgtggagaaataggaatgcttttacactgttggtgggaatgtaaattagttgaaccattgtggaagatagtatagcgattcctcaaggatctagaaccagaaataccatttgagccatcaatcccattactgggtatatacccaaaggaatataaatcattctgttataaagatacatgcacatgtatgtttattgcagtactattcacaatcgcaaagacatggagccaacccaaatgcccctcaatgatagactggataaagaaaatgtggtacatgtacatcatggaatactatgcagccataaaaaggaataagatcatgtcctttgcagggacatagatgaagctggaagccatcatcctcagcaaactaacacaggaacagaaaaccaaacactgcatgttctcacttataaatgggagctgaacaatgagaacacatggacacagggaggggaacaacacactggagcctgttgagggtgggcgaggagagggagagcatcaggacaaatagctaatgcatgtggggcttaatacctaggtgatggttgataggtgcagcaaaccaccatggcacacgtttacctatgtcacaagcctgtacatggtgcacatgtatcccagaacttaaagtaaaattttaaaaaataaataaagtaaaataagactttcacttactggggcaggcccatggtttctagggttgagaacaatctccaggggcttgaccctcaggaagggagaatcccttcttcccttgcagggagcatgggctgggtggcagttgtgtccctgccatctgaaagtgaaaagtggactttaaatgttgacttatatctcacaatactattggtgtccagcttctgatacttcatgggacattcctttgtacttgggatctaaccttattaatttagagagaagatgtagattaagtttcaaaaacctgaccttagaaaagatgttttaaataaagaatgggctatcatttgtattcgcaaatcacagagaatgtcccgtggcatggaatcattttgtcaagctctgcattccaatccaattttttatttgctctcatctcagggtggtaattgttaatttggagattattatttagggtggattcaacagtcttacatgggattctttttagggagaatgatgggaaattaccctttttcacatttttttatcctgggagagggggcctctattctttcgctcagtgtgacagtgagagtgaagtgaagagaagatttatgatgccaagatcagggctgagtaatatggtaaatcccagtttatcttaagtgcagtaaacccccaggcagctagaagagtgacgtattctggttagttcaacattctatttaatctgggaatacccaatagaccacttttccacaacagatttttatagaattcaaatacaacaaaatatacttgacaccacaactatactgaacacatatttatctcttctaatgacttaaaagacacttaaatatctcaccaagcctcagagtcacacggagaacatcagttatctcagaaacggctgttaatagggatttctggctgatagtgggatggcctgtttttgctgattgaaagcagcacttcattggatgcggtgggtggggggtgggacaccagttctcgttttcccaggtataattcggcaatctggggggcttcctcaaaaatacgtagaacctaaaatagataatgtatgaaaagccccctagtgctgagcctaacgcagaaaaacattcagtacatacaagatgacttgactcagtttatctgtgattggtttggtttacttttgcttttttcttttaggggtgggggagctcttcctacatagttaagggaccttcaactagaggaacttgatatacctaacctaggacaagcaggaactttttgacctccagcgttgtttatggtttcagactaagcaacaacagaagataactacaaggaactatcatgaattatggctaaatgctgaatggtgaccctttaaatcagttattagtatgactggattgtaccttctgccctgggacaagcctagacagagagagttgggagaagcaagtgtaaaaaagcctaggttgtttttctttttcttttttttttttttttatatgctgttaatgggagggtaaattcttgtaaagtttttggagagcgctttgaccttaattttgaaaatgctaagtttacatagcctttgtcttggtaatttcacttctacaagttttttctacctatgtgtaaggatgtctattacagcattatgtattttaattttgcagcaaaaaaaaaaaaaaaacttggggaaaaaaagaaatgtctgtgtagggtactggctaaattggtaaactgatatgaaataaaatgctgctattaagaaaggtgatggatacatatgaactcacattttaaaatgtctgagatttattgtagagggaaaaagtggaagtctgtatggataatattattttattgatgagaaaaaaattagatacatatacaaatgcatgtatattcatagcattttctggaaggatatataatatactgttcagctaatatataatttaaggattatgagtattataaattgaaattaatattattacaaattaatacaaattaagatttgttgatgtatacatagtattatggtaaaatgagtataattaaattattcaaaagtttgctttcttacatttgttaaatattttccagtttatgttctaatttgcttattccaatctttatttctatcacctatataattaaactccaattcagtttagggtcattcataatttccaaactgattattttactgtttcttcagtagtgttgaagataatgatgatggcactagtcatcccttattgaacccctatgatgtgctaaacacttgtacttatattttctctaaacctccaaaattgtaaaagttgatgaggaagcagaggccctgccatcttaaggaacttgctaaagccatgcagccagcaagtaagtttcagagctagcactgaaactcaggtctaacgccaaagactgtactatttccatatgtcattctgcctcagatatagagctggtgaattcatttttcaggcagtgtctttgtgggtaagacagatagctgcttaaaaagagatagaaaacatgctttggattgttatggcttgctagcattttccactcaccattgttattaattattctgtgtttcccatttgtcttaactttgatcgtatacttacaaagtttatggaaactgcccaagtgcattcgattctgctgatatttccatggtctgaacgccagccctatgagcaggggccaaatggagcatgccatctgaagactgctccagctttcagagctggacctggttcaaatgggaatgccataccactgtttattttaatgagataaagagcaaagaaaaataaaaaagcaaaatctgcatttgaaaacattcaagtaacgtaatctgtattagtcgaactaattctaagcctggcctggttttgattttagagatttccacagctccacgtgtacccccagggtggccatgtagaggtaacaacaacaatactaggaagaccattccaagcctctgtctccatttcttgcttttctgacacccttcacctgttctttattcagctatttactggggcatggtctttatctgaagtttttcctggtattttcaacccattaggataagtggggtgggtgtagggggctgtgcccacaaaacagacatccaacttggttttaggaaaggctttttagaggaaatgataactacacggagtcctgaaagagaaatcatagaggtagaggtgcccacttatctaggtagagagaacggcatgtgcataagggagagataaaagggcacacagtacatctgtacagctgtgagtccccaagcatctgacctctcttgaatgaggatattgactacaggttacttagttgaccttgttaaagccttatcatatcaggattaccagggtacaaaaacattcctaaaataaatggctctgttactaaacactccccttataacaccattgttgacactgtgacttttaaaaatctctcatatctggccatacctgtctcaccttcctaaagtcacactgacagatgacacaccagggcaagatgaaaactgtagggacttgtgtagaatgaaacgataacttcctgttcttaaaagggactgttgatataatatcctttttgcaaaaacagggaaatgcttaaggttggagtttctgttttcaataatgaagatggatattcacatgaaaagaagacaaaagaaaacagaatgccccagctgtgggctaagcagttggctatttttatttgtcaggacaaaaacatcaaatgacaattctttcttcatttctctttatgaatctagtactaaagaatgctactaaatcttaagttctattaactcctgacaatgtataaacttgggtttacagtttatatacaccacagttagggatttccatatatcctccagctagtcaagaaaacctttgtttggagttctttactgactattgcatcatccaaatttattttttgcctatgaaaactgaaaaggtgaagaccaaatttggaaattcacgtgtgccaatgcagatatcaacatgaacaaaagaaaaatacatgtattggactttggaaagtaaaatcacagacctattctggttcaaggtcagccataagtggaattgtaaagaaaggccagaaaataatatatggttcatactcaagaacaagaatggtcatatcatgtacaaaatgaattgagctaaaagataaacagtaaaatgctatggtttttattgttagcagacttccactaattataaattaaaggcagtcagtaatacccatagattaaaaagctagttgaaaactgagattcctgtagtaaatattaagcgttgtgtggtacattagtcacatgtgtataataaagacaataaatccatgtaagtacagcaatgatgaaatgtgcataaagcagtttgaactccacagaagtaagcaaagtataaatagatagcatgctcaggcacagagaaaagcaagtgctattttagcacttgagctagtgataatttattgttcaggctctccagttgagtcaatgtttatatggtgctatatattaactgaaaccaaaatagtctgtgcacatcactgtcttggatagattactgagtgatcagcagaaaccatatcaaacaaccactcccctacgagtgagggatttataatatttaaaatattcatcctaaagctccaagctgttttgacagttttgtctgttcataaatattcttcaaagagaggcagtatggcatatgtaatggaaaaagatagtaaagtggttagcattccaaactcaggacccagattgcctgggttcaagtcctggctctgttacttactagctgtgttgactttgggcaagttacttaacctctctgtgcctcagtttcctccttagtaagtggggttaaggatagtacctacctcatagggttgtgaagccgaaataattaatacaaataaaacatttagaataatgcctgacacagagtgagggttactacctagactctgccacagatcagcagaatgactttagataggttacttaaccttgacctttggtttcttctttgtaagatgcaaaggataataaacatcttacagtgtgactgtgagaatcaaatgagataccatatggaaagcagctagccctgaaggaaacacttcagattttcttcttcttgtctcttctcatcctttcccttgcagggatatttgtaaggacactttttttagcatctctgtatgtcaagcactttgttcctaccccactcacctagccttgaccatactttgtgaaatcacaaatagtcagacgttagaacccaaagaattgacctgaagacctgtccttttatcacgacactgcttttccatagaaatacttccttcagaaatccttttaagattaatgccacccaattctggcctactcacttcttgatcagtgtgggctgtattttcatttgtgacactgaatatgtttgaccatttcatgtatatgttatgtcttcccaaccaaagcctgtgttctgtgagagcaagcatctctcataactccctctggttagcctttcttgcctggctttcagtctgattggatcagaattggacaggaccagaggatttagcaggtcaggagtgattatcagctgtgaagttggcagtgtcgctaaggagtggaaccaagatgcccactgcttctggggccacattgatcacattcagacatccagaccctggaaaactcagggtcgtttctgagtctacagtctacattcaagaagaagggtagaaattcaagaagtggccaagaaagactttcaacaacttactcggatgtcatcaggggaagactaagagtatggccctcaaggcgccttcaaggatggcattacttgctgaattcatcatggtcggggggcttcaacagtttacagaagccttcaaatatttcaggaagcctctgcttccatcctactctcccctgatgggctacagtctgtattacagcaggaatccttttgcaatgagttgcacttatcttcaggcaaatgccccagatggggatatgaggttttatttacagtctgcaaaatttccctaaagagattggtgcaaagcagagctctatggacttcctcctggcatgcttgaagatctgatctgttcatccctcaaaggccagatccatctcttaggggctgacacccattaaaagccaactatataggtgttcaaacaagaatgccagtgtattcatctgtaatgagaatatttcagattaatattcatgcttgcctggccagcccatgctctctctgcagggaagttttcctaggaagccagatatgctgcagaggcagcttggtgagcacagaatctgaatacaggaagttagaagagtgggtcggtgtcaagctgagcccacacgtgcattcccaaggtcttcttaggtagttggtcaaggctccttatccatggccaaggccagcgttggcctctcaaccagcagccgatgagtccctgctctgattggtagctctgtctcctgcaggtactcagttgagttgtaatcaaacacttcaggattgggaccattctgtttctttgcggggcctttttctcttctgctctgtcatgcgtctgtgccactgtggtcctggggatggtatgtttgagggcagggccccatgcaggctccttccacagcataatggagtgctgccttaagatacactcaaagaagggtggtgagagaggtgtgtggttattcttgctaacataaattgcactgtttaatgtacacaagagatgggaaaaagaagagagcaaaagaattctctccaggcaaatgtttactatggaaactgtgtgattacagatgtccatatacaattctcagacatctgtttaagccccccgcccccgccccatgcagaaggcgatggcgtgtttcctttcttctgaactccttccacacatggaatgatgccattgccagcccttgtcttcagtcgcctttttcagaattggtttacttcttgttgtctttgaattttctctcatctagaggctgctttggccctctgaggtacccacgggcacagctgagctgatggccaagcgcggaggccccatctgcagctgtctctcatgaggaacagctgtcccatgcccatggggagagcaagtcctgtgtcccaaacagctctgtgccccacctcaccctcttcgccataatagctcaacttccatgaagcctgctgtgatgtgagccacaacaccaactcctgggtgggggtggggggcattttcctctcctggagcaatagaggagcagacacctgccctcttctttctctccctcactgctagcccacagccaagagggaggtgtccagaggggtcatttcctgccctctctggtggcttgccctccatgagttgctgttaccccttctgcacgctcatctgccagctgatcttacttcgggtggaaggttttgtgtttgttttccttccccagcacttccttgtccatagcaaggggtgggtctgagccccaccatcagtgtgacatgcatctgctcatttgtgcattgacagagattcgtcagtgacctaggcatgcccagctcggtgctgagtgctccaggcagtaccgtggcttcaacagtttgcagaacccttcaagtatttcaggaagcctctgtttccatcctgctctcccctgatgggctacagtctgtcttacagcaggaatccttttgcaatgagttgctcttatcttcaggcaaataccccaggtagggacatgaggttttatttaccgtctgtaaaatttccttaaagagattagtgcaaagcagaactctatgcaaaatttttttgtcctacatgtggtatgcatgtttgtgtgtgtaataaaactgcagagttgatttgcagaatgggccaatgaagcctgttttatggtctaatttatggcaggagaatggagtttgcacagccaccccttgtttcaggctgtttaatatgcagggtggctgtggtagctgctctctcttcttcctgtcacccaccctgtggacatcccccggtctcaagggagcagcatatgtttttccacagtcccttctctgcagaggccagccaaggacgcattttgtccatcaggtgttaggatcctcgctccatgcggtcagctggtggtagctctgtgttttctcagtacagatgtggctggactggcactgggaccacctgatccttcttcacagggctctgtttcaaaccgtgggctggtggccagaccctcttcagcctgagcatgtccaggtgaatctcctgattgtgcaggctgtggctgacagctctggatagggaacagcttccaaccttggctgtccactagaatcagcctggagtatttaaaagttctggtgtccaagccacaccccaaatcaattctgccacactccctaaggataagacccagtgctctccaagtgatttcactgtgtttgcaagattgagactaactactctctgggaaaagagaaaggaggaaagaggaaggcagagcaagataaggggagaagattggaaccagggagaaggaagaaatcaagggctggccagaggtggtgaagtaaggaggtgccccccagcaggtgcctggagatccccagcaaaaggacgatgtgcctgccccatctctgaccctgcacttggacgtgaggaaccaagagaggctcagaagaggaggcagggctccttctgtggaacctgcatgcatctgcccttcccatcagacagactgcttcctagccgtggatttccagatccagagttcactggaatgtctcttagcttctgtttcttcatccacaaaacagagacgtcaaatcgtacttgcaggttgtcatgtggatttgataggatgatggtgaagttggacacatgtctgacattctgcaagggaagcttaatgatgatagaccttagaagaagtccacaactctatttcaagttaaccctccccataacttcgttctctctgctgtgctgaaaggcagtggttctgaaatgttgttttaggagagctaaaaagaaacacagaggtccgggctcactgacgggtccaggcatctgcatttttcccaagcgccctgggtgattctgacggccagtgcttgggatcctctctacaggtgaaggtcccaatcgcaaagctaagagagagagattctgtgttgctcacagagctttactgccttccagggcttgttttgcacctcctagttgctctttctaatgatttcagtgactgtcccacctcaacataggaaagaggggtatgcgaggcgtgccagggccagcagccacacaggggtaattttggctaggttccacctttcatttacaagtcaaactgagatgaactctaaaactggcatcctccaaattagtaacctgcagccaaacaaggagaaaacgctttttcatttctggtggcagaggtaaaaatgactggtctgtcttgcatgttgcacttgcttgtcctgaaagctttacatttggggcctccgtcgtgagccatgagagtgcatggtgaaacaaagcatcttctccacattaatatttgtttttaaaggcatgaaaagccccttggatcacaatgaatcaaagcgtctgtacactgacacgtttccactgggcattgtgggaatgttggtctgtgggagcccacaggacccttggtggatttactgcttattgtttttgctgtaactataataggaaaagggatgtgtctgcccataggagcagctaccgtaggagccctgagaggcccgggagctggagggctaagggaccttgatgatggagagccccatcactagtagtttgagagccccatcactagtagggggtctaggagcattggctggagaccccctatcctacaatgcagcttcagttccccctgcttctccgaggcagagttctcaccaagggcagtactcagctggctggcagcgaagcattcacgttgccgtggtcagcctgggaaagtggaaaacgccatggagattaagcctggggtgggatgggcggtctggggtggggtgggcggacagcttctgcctccaccttctctctccaggggaagcagtgctgctcagcagcccccatagagccggggaatcggagcaagccgtttgttttccgtttcacaaaggaggagaagggattcctgctgcagtttttgctgaagagcaagacttcctagcaacacccagagcttctgctttagcaaaggattttaatatctcccttccctgctcttccccatttggctagggagctggtgtctgattcagaaaagcaacttggctataggacatcagtgttcctatggctaaaacacattttccataagccgtcaggggttaataaaatatcagctaggcatgtgtagtgggtttggaagggagaagaagggaggaaaatgaaagggaagaaggaatgatgccgaaaggtaagggtttcctaatcaggtgaagcatagtgcttaattgatagattgcgtagatggccatgtgcttttgtaacttggggctctgaggtctttcatgaaagggatagctataagacattcatcacaatactgcagaagtctcattgagtgagaaaagagaaagctaaatgaatgatcaatcagagaataaggacacttacaacagcaatgaaatcgagcatctgttgagctactgtgtgctatgctgcattctaaacactataatacctggcaactcatttcatcgtcataagaactctcaccggcgagttaggtactattatcatccccaccgtaggaatgaggatgagagggcttgatcggaatctcttgacttaatcaatgtgagtgtccatccaaggaccacaggtaagattcaggctgggtaaagactgagtcctttgctgagatatgctccctcccctaggtggagttgggaaccttcgcctccttacctgccttccgcaccgcaacatagggctttctgggaaccaagcccataggattagaactcctttggtatcgttacctttcctcacctttacaaatagcaccaggagaaaacatgggaaggggctcttgtgtattatagcaggcacagacagttccaaatatttgggatgagatgagagccccaggggccctagagggactcaggatggccttttcgggggctggaatgtacggtgtgtctgagaatctggcaatgctgccaaccggagcagctttctctcagcctgtctcaaattctctccttttctgcccatgtctagagaactcagacaccttttcttttccctccactccagcagccttactgagcgcattcccaactcacaggaaatgttcaggggtgggtggaccattcattcccactctccattgcagaatctttgtgtgtgaagggcaggaaaataggttaaaacagccattgggcactcatgctgtgcttcaggaagtctgctccaagattcccaagcaggctcaagaatggaagcagagagcaagccagaaatatccttactgctttattttattattattttttaaattgcatgttggtgcttttccattaattttaattgactcaagtcccatgacttttgtgatccccaaatcctccataaactcacttcaactgactttttttttttttttttgccttgaacccctttcccttccctgcctgggaacctgccctttaaattggtcatggctgggattttaatcactcctcaaaggcgcagtgacaatttcacaacaaagcagggaggttgggggtgggaaggggagggagttttgttttctactccgattaagagagcaactgttctctgtttgtcccctggggcccactcttggcaccaggctggggagacctcaaacttggtgttgcaacatccatcagacccaagtgagtctggggctcctcaaaggtgaactgcagctgtttggataaaattctaaaatcttgtttgggagattctcagcccttgttttacaatcgttcttcctggcaaagaaaccaggaagttttactttcccaggatctcaggcaggtaattgttttcccaaactgtattttaatctgatggaaatggacattctttgctctgagaaccttcgcccacatccataaaccgtttgtatccgccttgcgcatgggaggctcgattacacagcgccccgccctcccctgagacgcgcttccatctctggttataatttagggccattttcatttctaaacaacagttacgagccttttagtctcttggcatctcggagtgctttcctgttcagcggcggaccacagccaggtggtgggtgatctcccgaggttgggaattggcaaaatcccttacgcggtgtcatttttaagcaaagcagcataaacggtgacgagctggtagtttctgccataaccaatgctttcatggcccccaggctccaactgatttatcatgaggcctcttgctcaggggacttggctcacgcctgaaacaccagaggccccgagtctgggccctgagctcacactgggactgtgagcttagggaagtggctgcaccagtccttttggaggtgtgcacgtgccctcctcatgcaggctgacctggcggggctcttatggggaggaggggggctgagttaattctccacccctgcactttctggagatgcggagagtccaccacagggaggcagatccagccctccctagtgaattaagtgactgcaaacagagtcagcttggaagcttcaggcagggtcctaccccctatctccgccccttcttcttgggggctgtttcttgacccatcattaaaaatgtaaaagccaaaacgtttcaggggaaaagtccaatttgccagaataactttgttactcatcaacaaatactgatctatcacaccttgtgctaggtgcctccacgctggagaagtagccagcccatttaaaatgtcagcaaagattccagttgtctaaacgcgccagggacaggcaaggaggataagtggtgtgaggaggatgctgggactcagctgaagttggaaagctcacagccggtattcagagaactgcaacagggtcccctgggatattagcacgcggggaacctgccccagcatcagaggccctgggtcaggcctggtttcttaggtgttctttgtgctactcctcattttgtggagaggcatccttggtagaagtgaattttgtaaaatatgcaaaggtatggctgaatagtgaactcttcccctgtcctcaggaaaagcacatttggtacctcctgtcagaggggactcagcaatccactaaagactttttttttaatttattttttacttttgaaaaatgttggcagggtgcagtgactcacccctatggaagcgggtgaattacttgagcccaagagtttgagaccagcctgatcaacatgatgaaaacccgtctctactaaaaatagaaaaattacatgggcgtgggggtgtgcacctgtggtcccagctactcgggaggctgaggtgagagaatcacctgagcccaggaagtcgaggctgcagagagctgtgattgtaccactgcactccagcccagaagatgggagtgagaccctgtctcaaaaaaaaaaaaagaaaagaagaaaaacatcaagttcttcgggaagggttgggaggtgataaagagaggctgattaatgggtacaaacatacagttagatgaaggaataagttattgtgtttaatagcacagtaagttggctatagttagcaatttattatatatttcaaaatagctggaagagaagattttaaatgttcccaacacaaagaaatgataagtgaggtgatgagtatcctaaacactctgatttgttaggtattgtatgcatgtatcaaaatatcacatgtactctataaatatgtataattactatgtatcaattgtaaaaaaaagaaagaaaagactattactgcccttgcccatttacccgctactaccacccactcactcttttattcactgacttattcactgtttgatttattcatcctttctttcactcgttcactcactcattcaatcaacaagcagtccctgaacaaatgctgactctgtgcctgacacggtctaggcaggcaaacaccctattgggagccgacaggaggagggttttggaaccctggtccccaggtgcctgaccacccacattggcctcctaggctgccctcctcaggcccactgggtctctagtgtcagaaaggactggccagaggatgagagacagaccaatttgttaggttaggtctcatcattatagaaaatattgaatagtctgccagtgattttatctcaagcattctcaaaacactcatttccatcctgccattgctccccatgctaataaaggaaaattctttcaatagaccatgccaagtcctgaccagagcgaacagaacagctcgtctagggaagcaggcaaccaaaccacgctgtgggagttcaagctgagatcattttttagatttccctttgcttgaaaattccatccacaattttcacccaccttcccatcatcccaagtcatgtatccttccatcataacaagtcacatctccagtgtgagtgcctcccatgtcacaggcagcagagaagattacagtgaaactattcagagaggtgtgagccccgtagaaagctggagatcagaggatgcccgtctctcaggctcctgatactcttaagaaggtgtctaaatagattgtctcctgagtagtcccaatagctttgctgtctgatgtggcgtggagctccagacaactttgtctccctgagagtatttttgggcacctgtgtagtgggaggaggagagagcaagggttgggaaatctgactttgaatctcctctctatcatttaccagctgattgatccaggccaccccttcacttcctgaagcctgaattttcacactttgggttccttcttaaatccattggtaaaacaggtttagcaccaatggggaccttacatgaactaacagggctggaattcacctaggttgcccagctgtgctggctgcttacagctggctgaagcctagtctgattggcctaggtgcacactatgctggttgctagatgttttgaatatgacttttggaaataatatatgtgaaagtctctaggcagtacaacagatggttagctaattcgactatagcatttggctagtaccactcccacgtctaacttaaattatgtttcataatttttttaatcaattgacaaatggaacaatctttaaatttgcctgtatcttttgagggtcaacaaagaagttattcagtgtttagggctgagccttcttttccagtattttttcatgaatgctagtgatttggttgcccaaagttccagggaatgaactttatccaagctttggagagtgactgaggaagtgcttgtggggggcttgcgaatgacgataatatttgaggaaggtggcttttgacaaaatgtggtagacttcaaacaatgtcaagacagatacccctcaacctggatttgtgggtcagtgtggcatcttaggtgaaaacggcagacatgtgtttttaggagtatgctatatagttcttaatggaattccacaaaatttagtgttttgggggagatgacagagagattgagggaagaccgtagaacttcttaatgcttttttttttttttttttttgagacaaagtctcactcttgtcccccatgctggagtgcagtggcatgatctcgactccctgcaacttccgcctcctgggttcaagcaattctcctgcctcagccccccgagtagctgggattacaggtgcctgccactacgcccggctagttttggtatttttagtagagacggggtttcaccatgttggccaggctggtctcgaactcctgacctcaggtgatacacccgcctcggcctcccaaagtgctgggattacaggcatgagccaccatgcccagcctctttatgctctttataacagaaaatgaatgtaccattttttacttgggtctcagaaaagacaagtatgagttggtgtttaacattagactaggttgtaaattgacaggagagccatccacatacatcagaaaaagaggagcagagaagaaaaaaaaaacaacaataaaagacctgagacatccattcatccacccgtccatgcgtactagaaattctgagtttcaattgtgtttctcattgagttttgggttcatagtcttggctgggtcccttagcattaagtgaaacaactgctaacctaggaagtaggtaatctttgtttatttattatctgtaaaatgaggaacaaaagagtactcatttcatagaggttttaagaattaaatgagtaaatatacatatgtgtatgtgtctatatatagtcatatatacatatagtattatagatgtgtgtgtgcatcctttgataattaaattacagctatgtatcctctctccagaaaaattcacaaacacaagaaacttagcctaatattttcagagattttccaaagccatgggcctcattccaattatccaagtgaggaaaccctttctatactgaaattcttattatgtttttctcacttaaaaggaaactgcaagtcaaatttgattatagtcagtattctacaataaatatttctttgtggttttcatccccctaagatttttaagctcagtcatgtctagaatataccaaatgataagaagtctgatacaaacaagaagtcttgtcctattagagttcatagtaatagcatttgatctataataacagaaaaaatattgcatggacatacattaatctattcctgagcttaactccagatgaggaatcagtttttatatctcatttgtacagggtggagagagatgggcttttttctttcgatttgtttttccacgtctatttagagcaaccaaaataggaaaactgctgcacaggtcttaaaattcacttcctccatccgctttccgaattctgctccaggtctgatgactataactttttatacatgtcatttatttttatttttattttagtctaaatgtctcttcaaaaacaccagggaaaaacatttttagcttcactaagaaaacaaacatgtttaaacaacccccaaaatgttcaggtagagtcggtgtttttggcttgtgtgtattttaacggtgagcctagcaaaatatatgttggaaacagaatttttcttcatcttacatgtgccagtttctttctggaataaaacaaaaaggagaattgatcacaacttctatattggagctaaacttcttgtggttgtgaaaggttatttcaagttaaacaatatgatgtcttttttcagtttttaattacgattatgtgccagtttctttctggaataaaacaaaaaggagaattgatcacaacttctatattggagctaaactttttgtggttttgaaaggttatttcaagttaaacaatatgatgtcttttttcagtttttaattactatttatagacatcctgcgtagagtcaatcaatgggaatgcaggctatggtgcaagtgaagacaaagctgacctaaaggaggaatgaatgcggagttgagatccgttggtgcatcatgacttttctgccttcatgatctcattgaatacttttacattttcaggtagagttggtcatttagatgggaattcactgtttttgttttttgttttttgtttttgagacacagtcttcctctgtcgcccaggctggagtgcagtggcacgatctcggctcactgccagctccacctcccaggttcacgccattctcctgcctcagcctcccgagtagctgggactacaggcgcccgccaccacacctggctaattttttatatttttagtagagacagggtttcaccgtgttagctaggatggtctcgatctcctgaccttgtgatccacccgcctcggcctcccaaagtgctgggattacaggcgtgaaccaccacgcccggccgggaattcactgtttaccattttgatgcctactctcagggcatgattgttgagtccccaaagactcaagtgggaaaataataatattctgatgaaaaagccagatccatctcaccagttcttcaggaccaagcagcatcagggtgtttagtgtctgcgttgttcttgctcaacagacagataagtgaggaataatactcacgagtgaggagatagtagctgtgcagcaagtgagtacgtgaatgaaaggatgtgaaaagtaattaccaggtgaagtgctctgtccatctttagaaattgttcattaggattgtgttcattcactgtgtttttaaactattaatacataagaccatgctaagctcaacatgctctgaatcatgggagtcagaatcatcctgtgccttataggtattagcccaattacaggtcagagttgaaatctaactctgatatataacaaatgtatttgatattctatctaatttgtgtatatatttatgtatgtatctatttattagagatggggtctcgctttgtcacccaggctggagtgcagtggtgtgatcatagctcactgcagcctcaaacccctggactcaagcaatccttctgcctgggcctcatgagtatgtgggactacaggcctgtgccaccactcccagataatttttttcttttaattttttgtagagacaaggtcttgctctgtcacctaggctagtctcaaacttcaaggctcaaggaatcctccagctttggcctcccaagtgctgggatcacaggcatgagctatgtgcctggccatatttattatttttatctcttacagcttgaagcatatttaccatatatggactagctttctttcaaagtttcattttacctgtggcatcatatagctgttttgtgagtgcacttaactagactctattataactagatgttatcaatcagttggttattgtcagtaacatcccttctcatttcatgattataagtgctttgcccttgcaagccttctgaatgctcctgggccaccagttgctaagcattttctttacatgttatctgagtttatcaggatctcctaacctccctcactccagcagtgaatcaggctcattcacaccgtgctagtggaattgcagggtagacacactatgagatatatcagcaggctatttaaatcctttcatttcctaaaaggttaaaaggccagatcttagaaattaaggtgttggtttttgttttttttcttaaatccattaacctggcacagggactgatacttgaaaattacactagtaaactctggccattgtcaaatgatggacacgtatcacacatggcttatgaatacttaggcaaagcatggtttttagacattttaaaagttcactttgaattcagaatagaggaaaacattataacagtaagaaaatctcataaaagctgaatttatatattttactagcattatttcaaaaataaatcgttccttttctaatctgctcaaaaaagtctatttactaagaatacctaagaaaacattggcgtctacctgattctaagtttttggaagaagacactcgattggtgtaactctctatcagtgtccagccaactgttgacagtcacccatgtgcgacctgtagcttgtgagcccagtgaccgtccatgacaagcctgattaatttcatacctgctttgcacattatcgtttgtacttgtgtttccttatgtgcaaaatagaagtacgactgaatgaaagttttaaagagtgcagatggccccatgatttgaagtcttgagcacatataaagggcagacacaaggaaaatttgcagaaggataatgaaatgggagaagaactccaaagtgggacccaatttactggtcatataccgaatgtgacttgcatctcacagtgttagtggaggactttctctgacctggggttgggtcttttccgcataaacaccaaagatggaagaaaggaagcaaaatgtaatgtagctgagctttggatggattaagtcaaggtcatataaaacagttccaagcaaaagtggggcccaggtgtccatattacgagttgctaacattgaacactgactatgcacaaggcaccattccaagctcattgctatattattgtagcccattgaaaacccaagtttctagatgctgccttgtctgcttggtgttgcttagttcaatgagttattcattcattagtatgagagctcacacttaccatgtgcccgtcactgttttaagcatgtcgtatatagtaacatattttatactcccaagaacctaatgaggtatgcactatcattagccccattttatagatgaaaaaaactgaggcacagaggcatttagcagcttgcgcaaggtcatgcagtggtaagtgactgagccaggtttaaagccatgtgtgtgctgttagtcaccaagttaggcttccttccacatactgatcactgattacggtcataatatggctattgatgacatgagtttgcttgttacagttgcaaggaaaacattgaaaaatgtgtaaaagaacattaaaggatcatctctattcttctcaagagataagaattttaaatagcattagaattactttgatgacggccaccggcatctaccccttaaagaaaacgcgctgggcacggtggctcacacctgtaatcccagcactttgggaggccgaggcgggtggatcatgaggtcaagagatcaagaccagcctggccaacatggtgaaacccccttctctactaaaaatacaaaaattagctgggcatggtgtcacacacactgtagtcccagctactcgggtgactagagcaggagaattgcttgaacccaggaggtggaggttgcagtgagccaagatcatgccactgcactccagcctgggtgacagagcgagactccattgaaaaggaaggaagaaaaaaaagagaagagaagagaaaagaaagagaggagggagggagggagggagggagacagggagggagagagagggagaaaggaaagaaagaaaaagaaagagagagagagagagagaaagaaaaagaaagaaagaaaaagaaagaaagaaagaaagagaaagaaagaaagaaagaaagaaagaaagaaaggaaggaaaggaaagaaggaaggaaggaagaaagaaagaaagaaagaaagaaagaaagaaagaaagaaagaaagaaagaaagaaagaaaaacacgaaggggaaaaactattctgtctgcatttaacttagaaaacaagggcctgttgtttctgaccgcccaaaagaagccctccatggaatcgattaggaaataagtgtcaccagggatgatcaggtgcctgcctgtgcctgtagtgctgggaagcccatgttagattctcagaatcaaggctggagatacttcaggagagtcagccagaggctgggaattttgcctgtttattcaatgctgttaggccaataagcagctttcatcaaatacagttaagaccccaagataaagacagatgaccgctgagcgtgttcaatcctgaggacttgggttgttgctagttagttgttgagaatggctccccactttggattccaatagggaaagtgcaatgtttctagatcccaccctcaggtcaccttttctcttcctacaacatgcagaccgcctaaaaagccctggcattccaggaggactttatacttcacagaagatgagggaatctttggaaatttaggcgacagaggccagacataccaataaacggagcagtccacatttccccccagttggaaacagatcagaagctttaggcattggaaaatgctagccacatagcattctgagtttgagcatctcgtggatgtctggctgtggacgtcagctatggatgacgataagcctcctgtgactctccatgcagagtcatcagtccgtgttagaactgcagccagcaaagaatgacctcagagactatggatgtgcatcctccagggcctcagtccccacctcaacatttggcctgggcgatcagttccagtgttgacaggtggcagctgctggtggtccaaggggacttaggacatttttaattgttttgtagacatggaggtcttgctatgttgcccaggctggtctcaagctcatgggctcaagtgatcctcctgcccatgagccatcacacctgaccccagtcctgtttttaaatgtgcccagggaaggaattctaaacctcctttgtcagacttcactttggcaaaatgatccttggtacattggcaatggatggaacaaggaggcatgggcactcttgacacattctccaataggcccctctgcctttaggcagaaccacctgcccattccagccagatggcaacaatcatgttgttgttgttgtttagagaaagggccccactctcttgtccagcctggagtgcagtggcatgatcataggtcactgcagccacaaactcccgggctcaagtgatcctcctgcctcagtcctgctaattcctttatttatttttttttttttttgagacggagtctcactctgtcacccaggctggagtgcagtggtgtgatctctgctcactgcaacctctgcctcccgggtttaaatgattctcctacctcagcctcctgagtaggtgggaccacaggcatgcaccatcacacccagctaatttttgtatttttagtagagacagggtttcaccatgttggccaggatagtcttgatctcttgaccttatgatccacccgccttggcctccccatatgctgggattacagacaggagccaccacgcccagccaacatccggctaattcttaattttttttgtagagatggaggtcttgctatgttgcccaggctggtttcaaactcttaggctcaagtgatcctcctgcctcggcctcccaaagcactaggatgatagtcatgagccatcacacctggccccagtcctattttatttttaaatgtgcccaaagaaggaattctaaatctcctttgtcagccttcactttagcaaaatgatccttggtagctaggcttttcctatagcaagaagagaaatctgacttagagagaaaagttatgtatttaaaatgtcctagaaggctagatggatggatgatggatgttggatggagagaaagagaaaaagaagtagataaatgaatagatgatattcatgatagatgaatagatagatgaaagagaaagggaggtagatagatgaatgaaggaaggcgagaaagacaggaaataggtgactgtaagagacagccaaccccctagcaatgagacatatttattatagaattatacaccaaaggaggcctcttaaaacccattcaaaacagaagccaccttccttcgtgctcccatcacctttcccacatccctctactccagcaccttctcatgttgcaacattagaatttgttagctgttggtctccctggctggagcatgcgaccataaagcagggattacatctcattctgccgtgtagtctcagcatctagcccagtgcctagcacctggtcagtgctccatggaaggaaagacaaaaggaaagaaggaggggagggaagtacatcagtcaaccaatatgataaagaaacctgtataagacgatagtgtcccttgtcaggaatgcatcatttctaatgctgcaatcattaatgttttactaaccaaacttaacctatgtgatacctcatatcccgtcggtaagctgtcatactccaagtcaatacagtgatagcatctgcccagtgttggaggggtgtgttaatgctcactcctgtttaacactgttctaagggacaccagttcattattatactgtttgtctcctaaataatttccaaaaaatgtatttcaccagggttccctgttaatatgtatacgttttccatgatctgatcatgatatcgtatgggcttggccagtgagagctggcgcagtcaactgcagggtgtcctcccagccagtgacagtgtggcttctgcaggtacctcgttccccagtcaggatatgcgtgctgtccagggtccagggacgccgtccctgccccgtccagggtcctggagctggcttgactcctcgccttacatcccccagtccaaatcctctcgtcttccaaggcccattccaaggttggccaagtttctcctcctccacagcggatccttctccccactctgggagctgccttgtctttctccttagcacttcctggtgtcacatttcttcctgccaaccacctctctctggggcatgggactgggcagtctataaagccgtgagtgccccccaagcccacagtccccctccgaggaagccagccagcagctggtcctcatactgagggccaggctttgtgtcctgtgggtctgcaaccctggccataaccagtattggatgaaggacccttgtttaacaaaatgacagtggacttgcttcaaggcagacggcacagctttaaagcgatccagcaaacgaactctgcccatttggggcatgtgatttttgacaatgactgtctggctcaattagacccaacctgggagtgaactctgttttcaacattgtcatatagcttgtttgttattcggacatcccctcgggcttagattccacccccctcccctgcaagccttctctagatcctaaggtccttgaggacagagtcttgctcaatctctttttgtctcccgccagtgtctgggccctttgcatccctttgtaaatgtttgttgcacaggtgactgtaaaacacctaggcccgaggccttcacccccaaggagtcagtttctccacggctccttttccggttgtgtagccatttagcctgagagaggtttgggataggagaggtctctccaggattcctgatgagtgtggatgagcctgctgagcagggtatggaagcagaagcagccattggccagggatgtggttggagggataaacacagaagatgcctgcggctccccaagccagggaggtctgcagctaggggcctggaagatggagacaaggcagtcagagaacaatgaagacagagccagagccatgaaaagtgacagcagcaaacccagagagagggacagagaccaacagagtcacacccaatgaggttcatccaaaccaagacacttccctccatggttgtcagccctgagctcctgtttcctcccttgggttgtaaattcctcctgagcagtggttgtgtttattcatcttggtatccttagagccttgcagggcaccacatgggggctggcacatggtaggcgcccaataataattttgaacctgaattgaattaataaaaatattcttctatttttatttatttatttatttattattatactttaagttttagggtacatgtgcacaatgtgcaggttagttacatatgtatacatgtgccatgctggtgcgctgcaccaactaactcgtcatctagcattcacattttcttaatccagtctatcattgttggacatttgggttggttccaagtctttgctattgtgaaaaatattcttctattaattgacttgaggatttcacagtctctcttgaaaatctatctacagggctaccaaggtttccattaccttgaacgctgacgttcacgccttaaatctaactgtgctttcttgccatggcttaagttcatttctcctccagtggtttcaaatgcatggaatgatttttcagccattcaggaagaaggaatgctgtgtataaagcctggattcaataaagccagatttttgaaaaacagctctttagcatcttctactacagacactggtctgggcagggctttttattttattgaatccagctgaagagcttgactacattaataatgggcttcatttccaaccactgcctcccagtctttccccctaaaagcctcatggtacttaagcaactgctaatacaggaataattgtcagtggcatcacttcctgccgtgatttgaccaccaggatgaggttttcttcttgtacctaatctggagttctcaggcataccatgtctggggctgccagatcatatttaaaatttgtaagcaaatctaatggcagctgtgatttgagttgtattgagtttatgttgagaaagtaggatttgggaagattctcttgggtatgtagtaatatttttctggagcaagcctacctaaagattgcccagaggttcaaatctcttatttctacagagcatggaagggtggtaccatatcacagggtcctgagggcggactggaagattttactccattcatttcaaagaaaactctatttgttcagctcccataccaccaccatacttctttctgaagcttccctggaagatgacatctcaccatcagttttctttacactggacttgactcatgatggatttagtacacataactgtaacatggtatccatacagaagataagctcctctttgcttcaatgaaaaaggccatataaaagcacacacctattaacaggaatatagcacagccactaagagcacagactctgaagagtctgattgccagattgccagagtttgagtctagcttagccactatgtgactttggacaacttccctccaatactttgatctcctcatgtgtgaagtggggaatataatagtgcctactttttaaagtcactatgaagtttaagatgaatggatatttgttaagtgcttagatcagtgcttgtacacagtgctatataaatgactattgttgtgtgttttttttcattttactgaatatccaatacattattcctctccacataacttcctactaggataaaaagtaaagtttctctttcaggcaacatgcaatcaaatttaacagctggccaaaagtttagtaagaccttgcttattacacctttttggcaatattaaaataatatttgtttcaatctaaaggttgcttcatctgctgttatagggctaggcactgtggggccaataggagtgaaatatgtgatacccctcccaaaagaacttgcaatcaaacaatattggaaaatataagaagtgatatattaggtagcaaaacaaaactgaagagcagatgtgatgaactattggagaagtttaggagatgtagacattagtgacagcttgaatggtcaggtgaggaaggtaaggagattttcaggtgggatgagctgagctggaagaatgggttaagatttgggtgatgaaggtaagagtgctcccagaaggtaaagatacagacagtggtaaggaagggtggccagccatggtgactcacacctgtaatcccagcactttgggaggccgaggtggaccaatgacttgaaccgaggagttcaagaccaaccttggcaacatagccagaccccatctctacaaaaactagccagacatagtggcacatgcctatagtcccagctactcaggaggttgaggcaagaggatcacttgatcctgggaattcaaggctgcagtgagctataattgcgactgcactccagcctgagtgacagagcaaaagtttctcaatttaaaggaaggaaggagggaaggaaggagggatggaaagaaggaaggaaggagggaaggaaagaaggaaggagggcagagtttgggggtttgggagggtgaaggcatggaaatgaaggctctggtgtcttccttggaggagcagtgaggatgctgccctagtggtagccaaggattaattgtgccaagagcatagatggtgctagaaaatcaggcgacagtagctggattatgaaggtcttcacaaagcaggcaaatgagttcagatttggtttaatagaaaataggaagtgagaaagaggtaagaaacacgatctagaatgctggccagctgtgtcacccgcgtgcctgcctgcaccagtagtgtccccgagctgggcctgacaccattctttggtgatggtggaataaaggcaagttgaagaaataaaaacatgttcatatatgtgagttcccaagacaaaccacagcagatcccaggaatgtgtttctgattgagcaatgaagacgtgttggtggggttttggttggggtgggtgtgggtgtcatctctgtttcatgaggtctaaatttctactggctcagaaaaagaactttgagcagttttttgtttatatgggtcatcatcgtcttcaatttttgtggagttttctcagagcttcttgatggtctgctaatactaaaataaatatattaggccttttgcctgtctcttcttttctgtcactgggtgatggcctttgtttcctctaatggacacattccagatttgagtgcggagcgggcagtccctggctgctcatgtctgacatcgttccctccctgtgtagcaaagggaaatcaacagcacgtgggagggggaatctgtgttctaagaactgctttggtttacacatctatagataacactcaaccagcactgcaggtcacatggaccggctggtgaggctgaggatgagtcacttttaaattactcatagagaaagaaatatgtttctgaaagccagagtggttggcttacacatggaggtaagagagaaagcaggcagcttcataaagcactcagacctcctgtgacagctgacgtggtgtgtagtgcgtcaggtgggaagacggggccctgcgtcctcagcaatgtatttggaggtgaggctttttgttgatgggaacccctgtgctgggacttgggggtatttaggatacatttccatctagctagactttctcttacagtcccactttgtaaatggccctaggacccttgattaactttcagtaacacagtctagtggtgaacaccaagccatctgaggctgaaatatggagaagtatgtcagtccaacagaaggtcagatggggaggggcgagggagctttcagaaagtcttggagtacaagggcctcagctgagcctcgaaggtcttcattcgttgcaaagaagaaggaattctgtcccaagcgagatggaaagatcatctgagcaaaaagaaagcatcagtgacagaggctgcaacttcatttcactggctgagtctaaatttttttcacaggaaaaaatatacagaagacaagagaacaatcaccaaggaagcccaaggcactgcttactaaattggtccaagggggggatttcaccaaatgcaaatgaacaaagaacaatacatgtgactcaaaatatccgttatgctcttaatacttacgagagggtgtgaggcagggaggtgaccttttcaagggttgaaagctgtcaacttttcaaccacattgttttcattgctgggagattgaagacaggatcacctcagggtaccattttggaaaagtgatttaaaaaaaattaaaaactccttcctgcataatgttttgggacattttgaattgtttttgccgtgaagacatagaattcaggtgtccaggaaatactgcaaccttttatgagaaatgaatacccagaagtctagagctgcctggcactcactctggcaggtcttccacctctggtccctctccagcagaagggctagtgagcagtttaggacccctggagcaggggtacccttacccccaccccaaaggaagcgatgtggcttttttctcgcagccccgcccccatccctttgacaggtcactagaacaacagagtgcccaagtggagacagggaggaatgtgatggttggagggacctaaaaataaccatttttccctcatcctgaatgtgctaccctgggccagacattccctgaagggctcctctgaaatctgggaaacaggaaatgctaagaaaatctctaatttgcctggtcatgtgaactcctctcggtgttgaaacagaattttggaagaggggactctgcactgtggttgagccctcctaatcagagaacatttgcccctatgagaatatggtggatgtgactattcagcctcaacttccctctttctaaacatgtaaactctgatgcctaaagaacaaaaccagaaaagaaacccactcggtcttagttgcgtatctgagtgccgacagggcggctgagaggggcccacgtgcctgtcgctaaaaagcccctttggcatttcataacaggacccaatcccgcagacttgtctgtgcaggctcacgcaccatcttcaaaacctttactacctgtatttgtagtagatgattaatgattaggctttcttcccacacatttggctttgataatctccactcaaaaatattcagatgcaaataatttaaaaacaaagtggctccaagggctctttctgggaggatggaaatgctgcatatcttgataggggagtgagttaaagggatgtatgcctttgtcaatattcataaaactgtacacatgatatattcattttgttgtatgtaaatgatactgagaatgaaaactcttaagataataaagtgggttgagtttggaaaccagaaaaagtggacacgatgtaaatgaccccgctgaaaacgattcgagttggccagcagaaactaagaaatgcgtacgcgtgggcagtccccactgtgcggggaaatctttgcaaggtgagcagattcagctcagctcatagaaactccagctgattctgcacattcatctgtgtttttgtaggtgtttttggtgtctttgtgtccatttctgtttggctcatttccctactcaattggattttgacttctatttcctgaatacaacacccccgcaatacctaatatcccaggcctgtgaaaagtgaatgcctaataaatgtccactcactcactgagatggactgcttctcctgtctctgttacattctatcaaaattagccagtgcatttggccctaaatgcatttgtaaaaatggaaagtaaaaggagaaacattcatacttgtactagttttgagaaaattcccagttatctctgcttctaaaagaaatccgtttcagaacttttacttgggaaaaattgcttttgcctaacaggaaaaataaaacatagactccagacgcagtgatgttcgtgtgaaattaagaaaacagagttaatgttgatgtcttagtggaggcgaaggtacgcttcctttctctctttttcccccttttcaaggcaaatcagaagaccgggtgtggaaattcctgcaggtttgctctgtgtcggtttgcacgtttgtagatggagtttcatgctttttctcactagtcagtctttttgtcatcatctcatcttgaaactagagaggaagggaatggaagggcaaattgctaatatcagagacctctggaaattccccttttatggtacatgagtatttaagaacagttctctttcagttgtgtttttgtgattttggtgacactcagtgggcccagccctgcctctagtcagactccagtgtccttcagcagctctctagggcatgggctggaggcagtgggatggggggttaacgtgaattgcactgctttggaaaaacagcccaagagagatcctttttttaaagtagataacctgagcataaatctatactcacatgatttttaaaaattaacttatctagcatcttttataaactgataaatctctcatgaattaatgactcaccagtgcctaaatggtgggcagacaggcggcgctataaatttctcttggcattttgtgtgtcattatatatgataagttccagtaatggcctggcttcattgaaggttattttaaaggaagaagctttttatcccacatggtttcaggcaataccttattgaagatgacttagaccttggattctggggttggaacaggcttgtgtccactgcctaaacagggccagcacagcttcgtggggggcctctggaggaaggggccccaggaaggagtcaggtctttctgctcactggctgtcaggctgcctgggggtctcggagggtccagagcaactgatggctggtgtggaggagagcgtgtgacagccagtcccaaggccaggctatgagagactatgctaattagtgaagtccctggtagggccaggtcactcggccaccaggtaaaaagtaccaggttatttctgccttggcagaaggagaaggtgcatgaatattactcattaatacgcctcaaggaaccactaggttagacaacaaaataccttctgcatccactcccctattacttcctcactccccaaacatcctttcagtctgctcctccagcttgagaaaccaggagggtcttcctaccgagtggtgcctcccgagcctctggggtacagcttgtgaccctcctcaatcaaatgaatcccagggttccaggccaggtgagtatagatggacttggagcttttcttatgaaatgtcttgagctgagtttctttttcctgctacgccgaactctgtatatgtttgtttttgttctaattttggcttcagaaaaaaaaaagaagaaaagaaaagaaaaagaatgtttgggtacagtgtaaaagttttctcagatccagattggaaactccctcatcactctgaaaccggacaggtgctgagcggtatttgtttctctgtcaataaacagcacgtacttggcctagacataaactcctgcgggagcagtggtgcacatgggcctatttcagtgtttgggaaggactgaagggccctgaattaggaggaaggtctgcttctcaccccttctcttttgatcttctgatagagaccacatagtgttctcttcatggtattttgatggcatatggcgtataaacacaggtgtgacctttacacagtgcactgcgttacaattataataagtgagaggagataaagccagctggagtttaaggttaacgctgaaaacagcgaacgctaattttcactgaaaacaatgtcacagagcaaggcgtaggtgccccttttcaactgccgcgtgcatggttctatgaacagccccaggtgaagggtttccatgaaataagccacctcctggggtacagaaatacttagtgatgcatcctctgaggatcccctttgggaccaccctcctgggcggcatatcccaaatccttgtttggatgggaagggagcattaggtaacttcacttggaacaaggtaccatgattatgtctggtcctgttttccgtgctgacaggcagttcacctctccgggactcagtgtccttgattttaaaataagggactttgaccatattccttcagtttcttgccttctggttttttacacaagaggctcagcccagaagcctaaccccagatgcatacttaattcctcgggaaaacaaaatatttgtcagacccacaattaacttaattgtttatttgtgcaaaggctttcttgtttagttccaggacttgctgttgaaatttgaaaaagggtggccccagattcatgttcacatgagtagctgcggtagctactcaccagctagctcctgggagagaaaatggagaagaaagcgagggaagaaaacggagggcaaattctccaaggtttactcctccaccagagagacgcctcctgggcaagcgtttctacctggatccctggctgcccaggaaattggggaatgagggctttgggtgtggagtccccttggccattatgaagtccatggggttgcagttactgagcagagttagaggcattcctgcacccccacccccaacccacaacgtctggacttgggaggagattccttggcttctgaaagaagcttctgtttctgtttacgtaaacatcaggtggacgggggaggtggacgccagggtgggacgttcttgcagtgctcagatgagggtgagactggaggggccagtacaggtgttgggcatttgggtagcacctaacaataatctaaggcagtggttctccatggggatgactttgccttccaggggacatttggcacggcctggagacatttcgggttttcacactagacaagggtttccgctggcatgtcgtgggcagaggccagagaagctgctaaacatcctccagtgcacagggcagcccgtcctccccacaacaaagaattacctgacccagaatgtcaattgatctaagttctaaagcctactaatagtttgtaagttgaaagcactagattgacacaaacgggaaaagttatttgcagtttattttcctgagggacaatgggctgccactcccttccatgctattgctgggcaagactctatgttggctcttgctttcttctcctctttgaacacccccctcccctgccagcccgtctgatgccgtccaagcctttttttttttttttttttggcttctcagcaagcctcatgaatattaactgggacactcagggctaaaatgatctctggtcttacttgagaaatgccctcaagcaagaaaaagaacaagagtcccaagaacaccaagtgcccctcaccttggtcacaccaatggcccacactggctggggaggcggggaagggtcctgggagagggaggatgggcctctaacctccaaggagaacatgagtgagggccccaggaagggagagggtgcgacaagcactctggagaaagaaaggagagggttcaaggtgaccctgagctcggggcaagatctgcagggcctgcaattggcagagtgcctggcatctggccaagcagccctccctctctcttccccgctccaccacctgctcctggtcgctgcattgccggttcctcccagcctcttctcacctgctcgctctaacgtccgtctcagccaacagccctactcttccctcccaagccaacagggggaagcagagagcagcagaacagcctaaaggcaacaacggcagtctctttaccgcgcccaccctgcactcctgggcccctgtggcctccaccccagcagctggaccctccgagaccctccttttcccaccaagctcacccccactaagggccctccccacgcaatgcacagcacattccacgcccacccgacatcaatcacgtcctgtctcgtgactcatccgatactgttgacttgctgtacagtttctcacctttgcaaatgagatttgtcgcctcctcaagttgactgtccctggaggccaggagacgtgctgtggccctgctgtcccgagcctttctcagagtctcatgttcagctcagttctgttgattggggacaaaggacactgccatttgccacctctgcccgccctgtgccgacctccaccagacgtttggcatcatgagcccgtgtcgttctcaccccagcctttgtggttgatgttgtagcgtcctcttattcttatagatgaataagttgaggctcagagatgttagatatcttgggtaaggtgaagctgtgacgacttgagaacataactgaacgttctaggctccttaccccacacggtgttgccattccagtcccagaaggtcctgaggttcttttgagatgtgtaatgaatccatcttccttgagcataacacaatctttatggacctgtttaaatagttttaatttccatgtgtttactcattcattctgcaaacatgcacacagcttttacaaggtgccaggcactatcagaacctgggaaaaccaagatgaagaaaatgtagccagtgcccccaaggaggagagagacaggtggcagtgagttcactggtgagccttgagggggcagaataagaaaagggcatgatggggaggtgggggcttggtcaagaaaggcttcacagaggaggtggtatttgagctgagtgtggagaggtgtgcaaaaggcagagtggcatcccagcctgaggatgcatgtgagccaggatctgtagaggaacgaggctgcagctgatgctgccagtaatcacatggagttcaaggcaagcagtgggtgtggggagaggggagtctggaagcgtgggtcagggccagctcgccctgtggataacaggagccactcagggcatttggataagagagagggacgcaactgctttgtgggtctagcagacaccctgggaatactccagagggaagctgaatggggcaagatgagggaagatcggttgggagcttcttgccactgtctaggtaagccatgcagtggggtgaacagaagtggcttctgtaagaccagaaagaggagacatcctaagagacttctgtaaggtggagatgacagtgatggtgtgtccataggaaaagaagagggaggagttgaggatcaccccggtttttctgctaggatataggctgagggctgtcaagggggctgattagacccttagaggcagattttgggaaggtgtaatcagttccctttgtgctgtgttgggtttgatgtacctgatggatatgcagatctgtttggtcgcaaactagggtttgaggttcaaaagagattcaagagtcatgagcctaaaggcttcacaatagggttatagcttaatcctttctgtactatgaagacttcatgaatgtcccaaaatccacattcaggcctgcccttcccagagtcatcattgtcttctagaagcctagtttgtcccatttcagctgccctcctctggactcaccactggctttttggagtggccaggtctgtgtagagaattctgaatggaccattccaggtggggacctcatggcttagtacaaggtccgatgttcttgctgttgggtaggaaatcctgccttgatgagtctcaggatttggctggccgctctgccctgacgatttcaagaaatcacttctgctaactccagaactctacttccaggcccctagctgataatatacaggtattgagcttcatttgaattttttctttaagaacttaccttgactaaagatgttagaaaataagatcctaaaattaaaaattacggactctgcaaaaagagcttaactggcttcaaaagtttcacacaactcctttcatatatgcattttctgtaagctacttgtaaataaagaaggtacctaggaaaggaaaattgccatctctgacagttcaatgcaaaaatgagagaggaatgagagggagtcatgactgaattttagtgcctttgctgccaggcacttcacagaagtcatttcatcctcctgaccactcgacaactacagccttttatttttctctgttttatgaattcataaatttaggctcagggaggttaaataactcatctaacatgagttagatttaagcattgcagagaacgagaggagaactgataactcattcaactcattgacgaatctagtaatttgcagagttgaggttcaagcacagatctgtctgactctaatgtgtgtgctctttcctctccaatgctactagcatgggtgagctgtgagcattctggagagggtgaaaagtgggaggcagaggcaaaagctgagtcaaatagttttctcagatgagagagagtgggcaggcagtggatattcgtgcaagcaagttggacgccgtcagaaatctgagctgaagttatgtgggtatactcacgtcttgtagtctccgctgaaggacccattatcaaataggtggaaaatacaaaaattgaagatatggtgaagcattatcacctgatcaacccagcatcctgctctcataggtggtgtacaatttcacccagcccaagtcattatgtcttccaggagaaaaggaggctctagtaggcactgaggacaagcacatgataagctattgttttgcctcctgggaatacttggttggccctttattttttagtagcaagaagatttaggagtagcactctgtatgtatgttgattgtttggctttgtacacaaatgttagaaaattaaagaatagatttggtcattgtcatgtctgtttgccctcaccagacttgacttagatatggttctttaaagtctcaggcattttagaataactttggggaaggtatttacgaattaatttttaaaaaaactctttcattttagaattttcttaaaagagatatgtttttaaaatttcaaatacctagaattgggcaaacgaggtgttgccaagtagaggctctgctgagcaaataatgaccacatcaaaacaccagccccaaggaagcaggctccgattctgctcccagagcagcacattggtgtggtgtcaaatgcatgtttctaaagaactcaaacattgttttctcttagttagataaacaaactccttgatgtctatttatgactagttgttagtgagtctcttggaagtcatacaaagcagtgagaacaagaaggtgttttgcaggttggctttgagtaaagaccctctgttttgatcagggtcttggatgccctgctcaatcccctactcgaagttctgagggcatttctctgattgtcctccaaaactgtcctgccaactgctatagattaaataggtaaggagcagctactaagtttccttcttccctcccatgaaggagcccggccatgagatttagccaatgagcccatttaactctctgttttctagctcatttatccaagggttcagtgcaccactggaaaccttcatataacagaaagccagtgtttggggggcatttggtttcaacttgcttgtgtttgagcatttatatttataatagtgctaatctctaagggactcacatcgcattaagagctttatcttaggctgccacggaaactagcatgtaccaacatgactgagaactatgagaaattgggctgggcctacagaaaattaataagctccgattttcatttaaattatcttttccatgagattttgttttgaaacccacaaagtcgggccaagccattagcattccctatgcacacatttatcctccccctgtagcctatgctgtcccctcccctcgcccccagcccctcatctgttatcgccccccatctattatcgccccccttgcctgagtgaactcgcccttctctgaaccgtcatggccaccccttctgccaccaggacattcttgcttgtattgcttgctcctgacctcatagaaggaaaggagtagttgcatttttctcttgaatccaccccagggttttgatcatgccagtcatgttacagatgcccagtaatttctgctgggttagatgttagtcagttgcagggtagattggtgttaggggaggtagcccggccataggcaaaaaagtagcttagggtcaccgcagtcagtgtggagaagggaattttggggggaaatctggacagacgaatttgaccaatctatgaggctaattatagaaaaaaacacaagaagggggaaaatttctttcagtaattagagagatgacagagaagcagggaatgcccctgattgcattatagaagaggagatcaagatgacttcagaagtcatttgctgaaggtacaaagagagctcaaggtgaaaggagtcccattttccttcttggtggaggcgcagcttagtaacctttgaggagtgttgcctgtcttgctaggaaaaatatgacaggagtagcccagtggaggttggagacctaataccccttctcacccccaaacctgataactcattcttaagcatcaaatcttatgttatagtccaatatttctggacatttttctgccacaaggtctccagaatgtgttagcttagcttcagccttataggaattcatatttaaatcgacttcttttttcctacctggagactgctggaatatcagactaaaacagctcacgggaaggctgagcagagtctaattctagaacttgtggcatgttcatgggacacggaaaatacatagaagtgatggtttcacagagaaagggaaaagtcactccagagaaaactggagggagccaagaaaatgcggagagaaagtggggaatggcaacctcagacgcagagggaaagaaaaacaagagaagacgtacgttagcaataaaagaaaaaaaaccatcacaatgcccgttgggcaggaaagtgatttttctgcttttctttcagccctcctgggcccacagtattgaagataggagcagagtgcattcactggtgtccactcttcagctgggtgttgctgaagaagagagaaaccttagccatcttgccaccaggtcactctctttctttcgttttcaggctgacccaagcaaaataggggaaaattgcatctggacaaaggaaacttctctttctgtacctaaaagcctcatgtcaggctgggcgcggtggctcacgcctgtaatcccagcactatgggaggctgagtcaggaggatcacttgaggtcaggagtttcaggccagcctggccaacatggtgaaaccccaattctacaaaaaaactacaaaaattagccaggcatggcggtgggtgcctgtaatcccagccattcgggaagactgaggcaggagaattgcttgaacctgggaggcagaggctgcagtgagccgagatcgcaccactgcactccagcctgggtaactgacagagggagacgctgtctcaaaataaataaataaataaataaataaataaataaataaataaataaatgcctcatgtcaggagaaccctttctgtagagagccatataattaagcactgtgtttgttccaaacaaaaactagagaaagggttaaaaatcaatattattagtgacatctcctctcttcttcactgttaatcatctgccggtcactgtcataacagtgttatttttcaggcctgaaatgaaaattggcgattacatcaagcaaagagtttgaaaggaaggctgggttactgcatgattattcggactctccctgtaaatacgtgaatagttccagcttcccctcacatgggttgagggtaacagaatgacatctccctgggctagaagagaaacagagacagaacaagcgaaagtcgtctggcaccagccaacagttgcaacttatacatatagcccgggaccggtatgggtctgtggcctgttaggaacagggccgcacagcaggaggtgagcagctggcgagcatcactgcctgagctccggctcctgtcagatcagtggcgacattaggttttcctaggagtgcaaaccctattgtgaactgtgcccacaagggatctaggttgtgtgctccttatgggaaccgaatgcctgatgatctgtgttggaacagtttcatcctgaaatgatcccccaccccattcgtggaaaaattgtcctccacaaaacacgtccctggtgccaaaaaggttgtggactgctgacataaatgagcttgattcttttctcataatgtaaacgttatcaaagagacagaggtgtcagcataagcacgtcgctgctccatgcacacttatgacttcgtggctctgggcaggcccgtttagctgggagtcatagctacatttagggaggccgcgtgattgagtggaaaggcaggatattttatgtcagaattctgggtttgagttctggtttcataattgattaactaggtgtccttggaaaagttacgtattcttggtcatctctaaaagaggggtgacagcagtaataacttatctgtggcttgttgggaggaccacactagatgatctatatggaagcactttctcaacaacagcgtgccatgtgaatatttgtttttgtttgtaatagatacctctataataaggagaatgagaaggttattatttcatcctgtttgttcactgtttttatttaacaactttttttttttttcctactacattccaggcagcaggccagaggccagggaaattcgttgccacttcacagtatctcattgcatcattgagaggtttactcctgatccagcaccgaaagaccatttttggcctttaaaaataaagttgaaagtccaagagccagaaagattaaggattaagctaatttttaaaataacaaatgttttcttatattcttttctcatttatatggtgctggtaattttttaaattagattttcatctgggcattttatattaaaaatgatacagttccctgtcccttgtaattgcatttcttttgattttcttttattatgactcgcatatcactgacacttttttcctggaatgttaaaagtatacatcatctggctaaaaggaaaaaatactgacttaataaaaatggaaaagagagagagagagaaaatggatattcttctcttttggttccaaacaaggcaaagtcctcattcctcgttcttcatacatgccaaggttgatgtcacggatccaaaccagttttgagttatctgaaatgggggggagcggggaagcgcagttcaacaatcttctgaagcttgaaaaacaaatttgtcacagtctgataacccaaaaatgactgatggattttctctgcattttccaagcagggaggggtcgggcatggagaatgaaacattctgagaaaagacttaaatgtggaaacttttggttcaagagggtattctaggagatacaagaaatatctcctgggggcatccaaagggaataacactgtaatcttgagtgatgtatggttccattgcccgaggaatagggatgaaaaccataaactcctttggttggggtattaacttatcatcaaaagttaccataaataatggatattgtttatggctgagaagtaggacacatccagagaagacatcccttaatttttcataaaatcatctcagtgttattggaatatgtttttcatgccatttgagctgtcggagtatctcttgggtagattcttaagcagaaatagttgggactttacaaaccctgcctgggattctaatgtctggtgccatgaagattttggcttgtgtttcttttgatgtctagaatatcaagaacattcctagcttctatattacggcaggtcacgtcccggcttcttctagtaaaatcccctctaggattcaagcctctatttgcaccggtaataaatgtgatggcacattgcgactttgaatgcaagccagcagggctgcaggcacctgtttctcccagtgccccaactgtatcaaacccttttcatcctccctgcttttgatgcacaaacataaaacggagtcccagaatctaaaagtgatgtcacttgagtgtcaccaaggacctttagaggaccatggggcatctcttcctgttacaaatgaggctctcaaagcctggaaaggtgaatccctggaccacaagtggaggaactgagaaagggtgcgtcgacactcagaccccacagcttgccattgtgtggcttgtgatagaaccaagacatcagaacagaccagcttatccggttataaatctaggataacatgatgagcttcagagccaggggttgagctctcctgggactcctcccctccaaaggatgtgttccattgccaaacattaaaagctccgaattcttgttttctcgccaaaaggtattgtagacatgatggcagtgaaattatttttttcgcatttaaagttacccttaataaaatcactttcttcaggtggtgtaccaagttagtaaaacatacctgtttgaatctatattccatcaaccatgaacttatgcctggggatcaaaaatttcttaaaacccaccaggcgtgatcctaatacttttttcacagtttctcggggtgtttcagtaggttaggattacctccaaagacatttaaatgatgtttctggttcaaacggaaatgaaaagcacataaaattgtaagacataagaattccaagaatttggcagaggtgaaaacacacaaagaaaagatgaaatttagacgtttttattctgctcctttatccaacacaaatccctctccagttgtcccataaccacaatgccagcatttaactcctcaagggttaaaggaggcttgtagagcgggcctctggctgactccagcgtggatcgcaggcctggcgtcctgtcagacttccacggtcaaatggtaaccacactgcctctagttacctcgctccatttcttggggggctcagggacagccgccatttccccatcagtgtccacgaccagcgtccttctgccaggaggcgggctggaaggtccctcgcagctatggccaagccctggctgcggctgcagaagtctcacttgtttcactcggccaacacttaatttctttatgtatctgagggagtggggaattagtgtcttccaggaaattcaggctctgagttttctgtcctagactacaacaggcaaatggagaacgggttgtggggatcggagctgaggaatgaacttcagctgataaaatgcaagacaaggagggaacaggaaagcaaaggacaaagtgaaggagaaaaaaataaagggaattttggcagggaaaagggatttgggagataggacgggagtcctgtctgggttatagtgaaggcaggggagagaggtttgggggatcttggggacctgggccgtgtccagccattttttgtctcccaccaactcctcgctgttcagctaccccacagagcagggtcttgggcatcctgtgtgctgaggacagagctgagcttatagtcactgtgcatgaaggatgctgtgattctgcttttttgtttgttcatctttaatttggtgtattagagatgttgcactgaacacattccctctcagcatgcaactgccaaaatgctgaaagaaagtgtttggcttgttgggtctgactgcaacaatcacaaacttgccttgcaaacttctggccttccagtaacacatcgaacattaaaggattaaatgcttggtgagcagagctaggttcttgtaaaacacttggcaggtaggttcctaggaatttaaaggtatctgcctttgttaaattatgaagattttttaaatgtgagtagagaaaagctgtttccagtcatgaggagtcacgaggggtgcctccaggaggagagagaccatgcaagaagcaggtgacggggcagtggggcgagcggcccagagaagcccccccaccccctggatctcttgggcagtggggcgagtggccagggaagccccctgtatccccctgggtctcttctttgagggcttatgctctgtccgtggtgtggagccactcttgttcatgcacgttgcagacacaaccacttttggtccagcaagaatagttgagctgatcacttgaaaggatcaaaatccagttgccactgtggaagctctggggccacatattttaatattctaaattaggcctcaagttggatttgtttttgtgactcaaggaaattttgttctctttcacattctagaattccctgtgaagcagccctgtaaataggagggcttttcctgaataatatggaaagaatttctctttggggatttgagtctatatcatacaacattttaaaatactcttgagatggcacgtgcagccctagcaacagggccagaccacagtcaagggcttccagagtgtgccgcacacgttcccgtgggatccagccttgcacagtgcccagggcggcgggggcgggggtgatggggaaggtcctgtgactggtggtttctccatggtcacagggtcttctttctgttgatgtggccccattcgctctgactcacccctgacggcatacaccggcttgctttaggacccaccagggtggccccaaactcccatgccacttccttgccctgaaacaccatccttggttttcttgcttttatttgaagtcctgaggcctcagctcctgtctcactttctgtccgccttccagcccatcttaaacactcttggtacatttcttgagcgttccctgtcactcctcgggacttcctgtttagcctctcatatttattgctccgggggagccggagttggatcttgtatgtcttttctgcttcctttgggagaagcaaaatatagttgaaaaggtacatgcctggcagtcatatagtcctggattcgaaccccggctttgctgcaatgagctgagtgactttgagcaagttgtgtgacctttctgatggcagtctcttctgtctagagttgtttgtaaaagccaccttaatgggctttggcaccacagttaaatatctcttgtcatcccagatttagtgcctagccagaagtagatgctaaataaatactttttaaagtggtttgcctatggttggattgctcgattcagatatgtccaaaagatagatcaaagctagaggaaagaaagagctaaaacgagctatccaaagttagcgccaattatactatgaaaaacatgttgcctgtggatccaagattggccaaggggtttcctcagtggaaatagcaatttgcttgacctaaaatttctcttgaagccttcaccagcccaaacttgagcttattcctacgaccttaggtgtgcatatctctgagtcatcccattggaagagcgtttactgagtacctgatttgggtgatgagcatgatgtcctgccttaaggagctcattgtcatggagtcaagctcactatctcccctgcagcactctgcacaatgctgtgtgcaactcaggcggtcagtaaatgtttgcatccctgaatgcaacctgagccaactcgctccaaggtttctgcaatggcagcaaggttctgccagtgctacacatgcataggcatggccactgaccactcagctgccagtcccacctggaatattctggctctgccatttttgcctgaggaatagtcggtgtataaaggccccgtagcacagttcaaattccatttgcaatgcagccagcacatacttgcatcccttctgcaggcagggtcccccaggctcgccgctgcaagctgcaaaagtgtctgaccggtcctgagcgtttgacgggaagtgacagttgccttggaagtggatctcccaggggcacgacttttctcgtgttaagtgcccactgctgacaatgctgacaggccttgtacagtgggcacgtgtagtgttctgaccttgctcctgcccccaggaggccagcttcactggcttcactgtgagagcgtgtccttgggtcaggtcagccagctgtcaactgtgcccctgtaggttgtgctgatggaagatatttcagcccctccactcacttaaaactcatccatgattgctttcagcttctctttttctctttctctttgtctttctgggtctctgggtctcccgtttctctctctgagtttctgtttttgcttctctctctagttctatatacagcagtatccttcttgcaacagaaagcatactgtcagaggtccttcgccgtaaacagctattcagatgagaggccacgccagcgtatcttgtccatatgttaatgagccaggatccagaaccacaggctgacctggcccaccatttacctgtcctggtactaacagctgctgccactgacagagactgcattttccttgtgatagagaggtctgctgtcttccctgggcacaggaagactgtctgatgaggaaggaagaggattgtcaaagagccaagcagtgttccttgaaatgcatctggttttattcatgttgagtctttccaggtgaactgaactaaatcataaactacaaaatgaaagcagatttttcttagcatgcccatatggagctcactgaggagttcaccaccatccgtcagctccccttgtcccccagagcacagaggatgtaattgttcttctcttcctgatcggtagattgatggtgtggataagaagcctctcccatgggcttctcagaggatcatcgcagtcactttgacggtcacagaatgacccattgagctgcagaactggggagctgggatctgagtaagactattatacgttggggtgcttttgagtgggatgtaagcaggctgtgaagtttcagccatttgtgacttacctgccccaaaccaagaacaacagaaccagcaccatccggggtgcatctggtcctcgacagatgtctgggcctgcggtaggtcatcagggctccctggagctaatgcagtgtggagcttccagaaaagatgcccaggctgatttcttaaccagtcccaaaaagcaagtgccagacaaggcagggctggaggctggcagtgcccagctggctgaggatgccgcatcctccagcctagtctgctttgctctttttcttctacataccctcctccaggtctgaggccactttcagcaaattcctattaggacatgcaggttctttgtactccccacaccaccagcctcagtcaacacttactgatttaaacaagtgaaaaccaaacatttggcccctaactctggccctccacgtttaataaatgaaggactccctcccctcactgcccccagcagcgatgtcctgatgacagcgattaggccaagctgcagaacttaacaagcatctgctttcagttcccatttttggcgtattttcatgaattaactcttgcagtgacaaaaatagagggaggcagcctgggccatgccccgtgttcacgagtcacatggcaggtacaggagccacggcacgcttggcccaaatcatgaccgacaagtagagcatatttgcctgtcgccaatccctgtggagcacacagtgattatgttctactcacatacggagacaggtatggacagtggcgtggggtggggaggagagccacatgtgtggctccagatcccaagaaaaaagagttggtggatctattccaaacgccagtctgcctgtggaatccccagcccctgtcaggcagtggagagtcctgttcggtattgaatataatcagagcttcccacctgctccctactttaagccacactgatgtcaccagttctaattaaaactggcatgagaggcagagggctttgtgggcatatgggggttggggtctgggacaaataacttggattatgctcataaaagcaaagagattggaagcacagaggcacatcagaggtcacagcttcagtgctgtgccaagaaaggcctcctcctaactcacagcaggagggtctgaggccaggtggggagaagagcagtggagaagtggcggatggaagagatggaccacacagagaggaagcaggagatcctctgcaatagttacagtaacacagctctggcacgcaccaacagaacccaagtcacatcctcaaggatgcacgagaaagggtgaagaataaggtcactaactaggtaagcccagatggtagagcggagagagacttcttagaggttcgctacggcggagttttcagatgaggaaaattgaaggtcccaggggtgaagtgagctgctcaccttacaagtaggagtgccccgattgctgctcatgcatccgacccctaacttctcatccagaacacaaaccatgccacctcctactacagttcttcctttttttcttttggagaatgacagtggtgcacattttctaaccagcagcgtctcattcctcattacacttgtgagccgaggatccatcacaagccagtacttctgtggaattccatatggtataaaaatagtttagtccctcttcatgtcgtgtaaggaacataattaagctcttttattgggatatagttcacgtgccataaaattccatttaaagtgatcagcgcattggtttttagcatattcaaaaggttatacagccatcacccttagctaattccagaacttttccatcactccaaaaagaagccctgtacccattagcaatgactccctagtctccccgtctccccatctcctgggaacctctaatccactttttgtcttgatggccttgcctattttggacattgcatgtcaatggactcatagacagtgggtggcctttgtgcctggatccttcacttggcctcatgtttttgagggtcatccatgttgttgcatgtgtcaatgcttcgctcctttttttggctgagttgtaagattccattatgtgggtagaccacattttgtttatttgttcatcagttagtggatatttgggtcatttccacttttggctattatgaataatgctgatgtgaacatttgtgtacaagttttcgtgtgaacgtgcaatttcaattcctttgggtgtactaggagttgaattgctgggtcatgtggtgactctgtttaactctttgaggaatcagcaaactgttttcccacaatggctgcaccagtttacattcccaccagtcatgtgcaggggtttcaatttctcaacatccttgccaacacttgttattatctatttttaaaattagagccactctagtggatgtgatctctccttgtggtttcgatttgcatttccctaatgactaatgatagtgaagcatctcttcatgcacttactggccatttgtgtaccttcactggtaaaatgtctaccagaatcctttggccttttttaaaatttagctacttacgtttttattgttgagttataataattaagttttttgctggacatattttcatgtccaacacaatatcataaaagtgttaagtttgtcactttatgcttgatacttccccccgaaacagtgaaatagcataagcccaaaacaagagagggctgagcaccacaacaggcagggccctcggaagctctagccaaaagaaggtaatggaatgaggaaggtaggaagaaaaatgaagaaacttcgttttaaagccaaaacactggaaagcaggtgactgaggcctgtgtgtatataggccctttctttagggcctcttcaggtgtgccttaaaatgaggacaggagcatgggcctgttctctcctggcaaggccactgctgggcaaatgggcctgcagacaagacacaaagtgctttgaattcagtactaagaaaattatcaggcccatggaagccactgggaatattaccaagcagttactatagggcagggcatgtgtcttatttagctttaagctaaatactcagcaccttacaaaaatagtttggttactgaatgaataagcccgctgaagatgagatttcaaggtcatatagatacggcctttagtctctcttgttatggtttattacactaacctggtgaaccaaatagcataactattaacatatttttagcactttttgctataaatgcatttctccacctatttcagaagtacgtcttttgaattactggactgaccacaccttcttgcaggagggacatgagcccacaggtgccctgcagtatttgcatagctagtgcggcagtagggaacttggttctgtgcttccctccagacaccatcttctaccccagcccagaaggtaattagactaaggaatcctctgaggtccatctctggaatagccagctccggctgaagtctccattagcaggtggttggggccaagcttcctctgccctggcccatggcataagccatctttgcacattattttcaaactgtgaaaataatgccagagaaaggaagcacccatttgggcttctcatttttcagcctccccagctcctgagggcccctgcctgatttgcattcttagctaaatttgcataacagaacacaccagaacttccctggaccaactgtggtaagcgggcaagttttgtttttgttttgtttgggtttttcatctcctgccatgtctccagcaggtttcttgttacatccaaatgacatggagattaggtttcacgaatgtcattggcccatgtttcaaccagcccctccccctggacccagagttcctccaagatcaacccccaggcactggagatggctttggggagcagccttcgccagcctggaggaaggcaaatccttgtgcttctcacgctcccgtgcctcttcaccatctccggcccaggcagctgtgtgtccttcagttatatgctcaagggttatttttttccctttccttttcccccaaacccggaaacaatattttgggagtaaagggagggtgcgggaggaagagtcacaggggacagaagcaagcatgcagctgccaaagccacactgctctgcagacggaaccctctagactcattcagcacaatgtggctgtggaggaaatcctgccgagccgatgataaggggggaaatggagtcacttcctcaccagctgctttattcaggtagaaaaaagtcctcacttccttgcgtgtgctctgccggccaccactcccagccgccagtgcggcttgctccccctcttgctctgagccaactctggtgtcaggagaatcttgcttggcttcatggagcgctctttctgcaagacaagtgtctgtctaccccacttcctccttcatgtcctttctctttctcctggcgttctctctcacctgacggttgcatgtcatagattctgtgtggccgcagtagtcacagatagtattgccaatgagtctccagccctcttggtggaatctaggatcaggacatacccagtggtctctacgtttgcatagatgtctagaaacagcctttgacctctggtcgtctcccctgccctgcaccacaggcaccaatgctgcccctcttgccaatgccctgctattgtcctttcaccctcttaggcagcacttgtcaaagtttgtcttcctaatactccaaacatagcagcagtctccttgacagaggggttaggggccaaatgagtttggaaaatgctactccctttcttggagaatcaagcacctgtgagtgggggtgataatatttactaaccaatatagcagggacactgaccagtcagatccctctgtgtccttgggaaccggctaaccatcagtccctgggaggaggacactagaggctgctgctgaaagaaaaaaaaagcactgaattttatctaagccagtcctttatttggtctctgaatactccccttttaaaaaaatattatctattaggatgtttgaaaaatctgccatatagtaaaacaaatcagtttgtttcagctccacaaacatttgctgagttcctaacgtatgacagacacatgctccagggatccaaagataaataaaacatggtcctgcacctccaggtgctaatagttgaatggggaaggcagacatgtaaacagatgatcttcgtataatactgtgaacagggaacagccgaggattatttagctcaacctagggatttggagaaagttgcttgcagaaaatgattgagctgaatctctgaatgaaccaaagttgacttaagagtgacaagctgagcaggagaactaggttggagccagagcattgggaaccttagacttaagcatggaagcaacagatttgattctgaatggatcactctggctgcagtacacagaagagatttacaggcaaagcacaagactcagacagaggcagagagatcagactggaaatcacagcagtgatcctggggagagaaggtaaagggagagagaagtgttcaggtggtaaaattggcagtgcatctactgccctgttctgtcctgtcccctggcctttaccacttcagtgctcactaacttcacctccagctataagagatgtggcatctgtatctatttccttgattggtacttcacctgtgacatggccagctaggagtgctggggtattgacattccataggagcaaccttcaaccaatgaatagcaggagttggtgtataaataccccagctccctagtccctcagtgggttaacaagagatgcatggtctacaccggccctcagatttccctggcaggagtaagctctgtttgccggtagcaataacttgcttgatgaggtaactcatgcatgagtcttttcctttttttctctcccttccctgctccccttagagttcctagcatcatctcccaaataaaccacttgcactcaaatctttgtcttagggtctgtttctaagggagtctaacctatggccatgggatttactgttgaatgaatatggggcatgaggaagagaaaaacatctaggagactctgaggctgtaggtttacttgatgccatagccaggttgaagacaggaagagagggaggcttgatggagggagtgatgatagcttgagtttggggcaggttgatcgaactccctaggggatgtcttagaaagcaattggaataagtatttgccagttaggggagaaagtgagactggatataaagatgttaggaacattatcataggggtggtatataagaccaagagagtgaaagagattggtcaaagagagaaaagaaaatgtccagacagaagcctgatgggcagcatcgagaacttatcagaataggccagggaggaggtgcccctgagggagacagagaggaaattcttcaggaggaaggaggtagcccaaagggagcagagtcacggaagaccctcagtggtcttggtgtccggggcatcagagcacctactaagatacaacctcacacccagtgaatttagccacatggagggtattggtggtctctgtgggggtggtttcagaggcacagtataggaagaagccagactgaatgggttcaaatgtgggtgggaagtgagccaatgagtgtggcttggcagcttttctaggagggcagagacagagaagataatggttagggtggagcacgcatcagcacagacattttgaggatacctgaggtcagaaaggaaggatgcgattgaaattgtaattgagagcagggacaattgacggaggaaggttcctgaagcaatgggagatggtggaatcagggtgaagtgtggagaggagcagggaaggacaggcagaaatggacatttgtgcatgggccagggtggaaagctgtggtaattcttgcccaatgatcccagttttctcagagaagtaaaaggcagtgttcactgccaaaaggtgaggaagatgtgtgagacaagtggtggctgttgggaacagtcatcaaaaggaacagaaaagatctgacaaagaataaagaattgctaggtggtgtcagaactcactgagtttagagaccatgaatttccagcagcacctgcctgcaaggttgggtaactttcttcagcaccacttggaagcccagatgagacttgttttgggctggagtccaagttggggcagagaggaaggtcgggatgggaggaagcaagttgagggaggcagggaggaggttccctgggtagagagaagaaccagctgcttgccagcattctaaccagtgacatgcaggaggcaggtgaaacccagccttcacgctcctgtccaccacgaatttccttatgaatacacactgtaaggaatttgctttacctgtcaaagtttcactcacctcacctatttaaaaaaagagctaatatctttattagacattattaaaccaattcagggaatctgaacatactttgaggttccttccagcccagagttttctgttacagtgattctccctttccttttttcttcctaaccctaaagttgtcatgagagaagagatccccagaggtccccatggagacaaaattataaactcatgaaaaatagaaaatatcaaagtcattcgatagctgtgtttgatttcccattggcatggtctgattttctttttactttcttcttactgccgatgagactctgcagtctgcaggaacaaaatggcggcacccattgatttagtttagttcaaatgtgcacatagaggcattacctctctctagagtgtaagctctttggggacagggtggcttttctcccttagaattcccttcgattgtataacgtctgcatgcatagtcagctcaaagactgtggaatgtagctgaatttcgaatttgcttatagccagccaagccatattaaatttccccagtatatagagagctgagaacacacactgagctcggggcctgaacctcttattgcaggcattggtctgaggggcagagctcatgagagttcttctgggccagggtctaaggaggccctcacttaaccgggggcctgttgcatggttctaggtcatggctgctgcctgggagcccatgtctccccactactagacatcatctcccagcatttttgtctgtcaaattatggagtctggatttttttcagattaagtaagcacttagaatgtaacattattctatgtagtatatattgaaatatatttcataaatagtaatatacatgtttgtattgaattagaaaagacagctaaggaaaaaaatcagaatagcctcttaaatgccatgtcctcatgcctacttctgccttcaacgataatcactgttaacatctttgcgttttcctttatattatttttttctgtttgtaaacgcgcacatgtatatgttaggtttttacagaagtggaatcgtgttttgctgaccgttttgtcctgctttactcaatatgaccttaggaacacaatttcttgccaataactatagggtatgacttttaatgctgaacagcactccatcatgtggacgcgctgtcagtcatctattttcagacatttgtttccaggtttatgctattatacataatctgtgcactttattatttttccaaaataaataactggaagtgaaattactaacaaaagctttttaaaagccttttgatatgcattaccaaattcaaaaggtctccatgtttacctttacctgggcataagggttattttgggacccccgcccatatccccaaccgcatgccattcttttcagcacttagaattaaccttctcttccattcttgacaatctgaccttttttaaaaaaaattctcattttaggtttacgtgaaatttctcgaagtggaccaggggtggtggctcatgcctgtaatcccagcactttgggaggccaaggtgggaggatcacttgaggccaggagtttgaatccagcctggccaacatgaaaccctttctctactaaaaatacaaaaattagccgggcgtagtagagggtacctgtagtcccagttacacgggaggctgaggcagaagaattgcttgaacctgggagccactgcactccagcctgagtgacagtggctccatctcaaaaaaaaaaaaaaaaaaaaattcttgaaggttctgaacggaaaaggaaaatgttggaggatggctgcctcccaggtgggagtgctccatggcccggaggggtgaggacacctttgctgagtttaggagtcttgaccctggtctgttcccgtccacacctacctggcctggttccaaacctgcagcaaggctgcggctgggagtttagccatcctgtccccttgggccagccctgggtggaactcagatcctctgtggcctctgaattggaaatttatggggaagccactgtggacagagccaccagagctgaggccctgcccatctcctcctcataggaggagccggtgccagcctttccgtgtgaacctgtgatccgtgaagtcgggtaagcccttgccagtcctgacatgagcaagggacacagagcttcctaaatatatagactgggattttgtccgaatcacatgacgacccaggttttctttttccctctttgttgcttttaatacataaaatgagcatgtgtttatttaaaacagctttcaaactcaaacaaataatgacagactgttcaaacagacttcggaaatcgccccaatcaggatgtttgaaaaatcaggaagactttctacgaaagaagctttcaggtcattttagtcccgaagccgcagggtctcctttgcactttggaattgtagaagggcaaagtttagaggccagctccaacctccagggggttaaatgacttgccctctagccctacactctaataatgtgtaaagaaggacagataggtaggcattgtattatcacttcccatctttgaccagaacacgggatgtatacattttaattcataattcctatagaaattacggactatcctcagatcagaaagctaagagaggaaattgcttctgcaaaacggcaggctcagcagaacttcttgggggaagggcaggttgagtaggtgcggagcaggtctgcaagaggacagacaagagcaaggtgtttgttctgccacgagctcactttctgtatccaatttacaaatggctttgagtgacctacgttaatcttcacaataatgaattttatggctatggatgaagtaaatgaggctcggggctgggttatctgctgaaggttataaactaataaaatatcaaagccagggttcacccacactcctcctccaagtcccatgcccttctcagccccctgggatggcaacagcatctctatgctgaggctttgggccaagagctgctagtttagctcatctcactctagaaatgacattgttctacgtaatgcatatcagaaatggcctgttaggttcatgagaagcactgttatttgtgtgggggtgagggtggtgagagggaattattccagctctgaggaggtggggatatttgggacagcatttcttctgctctccagcactgtgtgccagaccaactgggagaaaatgccagctggagtatgtccctgcatcctccggtttcccaggatggcttcaggtccagacaggacaaatgatcaggggcttagtctggttcagattttgccacacaaaactctgttgattactaaagggattcagagcccggccactgaccttctcaatgtcaagccaaattgcagacaacctattgccagtgccctgacaaatttggggtgtcttttggctgggctattgggggtttcagcctacccatccctcagagagagaagcatggatgggaggactagttgacatttgcagccgtgtctgtgatgtcttgggttgctccctggaagaggcagagttctggcttgtggagaagtcctgactccttcctgccccactgatccctgcttatatggagaggggtgtgcatcttggcagacaatcatgattgtgccttagctctgtgctaagagcactaaacacacattttatgtacgtctattgcctcgcttttctaacactgaaatttagaaatgtttaacaatagatatttaaaaagaagaagaaagcccttgcgccctctcctggtaaaagttaaccaaggacctccaaagatgcagaaggcccactgggttagcagtcgctggtctgggctagctgattgtgctgatttgaccaatgctgttgacacacaggatgggtcatctgttcttctatggtctgtgattacagagcatcttataaaccagagtttctcagcctcggccctgttagcattggggggctgccctgtgcattgtgggatgttgaacagcatccgcggcctctgcccactagataccagtagcaccctcaccccaaatcatgaccactaaaaatgcttccaaacattgccaaatgtcccctgggggacaggatcactctcagtgtgaccctcgccctaaattcttgcctgccttttgtaaaaggtggcattggttggagggcaatccatgagaatgtgaggatggctcaaggcaagcccttcatgatgtctggaagcaatattgatgactggttaactgaggtcacttctaggagtttgtttcaaaaaagcaactgaacaaatagacaagaatttatatacaaaaatatatcatgatattgtttataatagcaaaagttttaaacactataaacatgaattttttaaagtatggcacattttatatatcatgaaaataattgtataaatctatatttaataatgtggaaagttaccctaacaatgctttaaatcctcatcaagactacctcaggattctcagaggctgttacatatagaaggagtaatttcaaacagattcataagcatttgggtaaagcattaagccaaagaccaatgattgtattcagaaagcttaagtgaacaaacatttactacgcacctatagtgcaccacaaccatgcccagcatgagggagacaaagagaatccctggtcccactgctacagcccttgccccagagaaagggaacccctctgtgcactgttggagcccctcccaacagcgatgtccagggtcatggtatgttactgtttcctgtaataaaactgtgtgctttgagtcagggttgttgggaataatgtgaaactattcttgttttcttcttcatcctgaataaatcagaagtaaaaagaattcatttactgatttatatattcaaatattcattcagaaagttgtccaaatactcattggacccaaatgtgaaacataatctccccaaaatctaggaaatgagcaattggtgatttgctcaatccaagcccatccagagggtagactttgctacaacacactacagacccgacttgagatggagagataggaatggaagggagacactttttgtctctcagggacctgcacatccagtgacacacccctgatctcctgccttgtgagatccacaatttgagtaaatgcagagttgtggtcgtccagtctagccacccccaagagaaaccccctgacagctccctttccccaggagaaccttgaccttagaggttggcactgcaccagtcaaggccgcccttggcccctccactgactgagcccttgactgaccaaatgctctcatagagctgccgttagccacgccagggcatcagcagagagaagggtgctggtttctatctgggttcaaagcctggctctgccacttgttaaaaagtctcttattccctgcgattctcagctttttcatcttcagaacagaaacaaataaaataacttcataagattggtacaaagaattagctggatgagaaagcgcatgcctttaatcccagaactttgggaggctgaggcaggagactcacttgagcccaggagttcaagaccagcctggaaagtatagtaagaccctatctctacaaaaaatttaaaaattagccaagcatggtaatcctaggtactcaggaggcggaggcaggaggatcactcttgagtccaacagttcgaggctgcagtgggtcatgattgcaccactgcactgcagcctgggcaacagagcaagactcttgtctctaaaaaaaaaaaaagaaagaaaaagtttggtacaaagactaaaataatgcatgtcagacatttgataagatgtcaacactcaatcgaggagtgtgacggtcatcatcattgctagattttattacttttatggatgggcatgctagctaaaattgcaaaacctctaatattttctaactgcctctgctgtttttctcctcggcccttagcactctctcctacaccatgtgataatttatattgattgctgtctatactgttccactcaatggaagcttcgtgaagtaggaacttttagtctattttatgcactgctgtatctctaagatggctggcacgtaaagagggtctcaataaatatgccttgaattaatgaaaacagtggtttctgaatcatggcctccaaagagcatttgccttttcccctctcacccttctgaaggtgcccaggctgccctggcaggatgcctctttctctgtggggtggcattctctgctctctctctaatactctttctttttcttccctcctctcccccaactgcaggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 41 - DNA, 180812 bp, Sus scrofa
ccagcgaaggtgccgggagccgagccctccccgccggcgcggccgtcatcgccctgagcgggagcgcgggggaggcgggcgcagccagctctgccgcgcaggagcaggaggaggagaaagggtgcgcagcccggaggcggggtgcgccggtggggtgcagcggaagagggggtccaggggggagaacttcgtagcagtcatcctttttaggaaaagagggaaaaaataaaaccctcccccaccacctccttctccccacccctcgccgcaccacacacagcgcgggcttctcgcgctcggcaccggcgggccgggtgcgtccagccttcatttatcaagcagcttttcggaaaatgcatttgccgttcggagtttaatcagaagaggattcctgtccccgtccccggctcgtccaccggcccccggtccctgtctctctcccgtggaggcgtgaagcggccccgcggatagaaatccatgtccgtgcccgcgcgtgtgtgtgcgtgtgtaaattgccgagaggggaaaaatcacaggacttctgcaaatcccggactgaaaattgtaattcatctgccgccgccgctgcctttcttttctcgtgctcttgagatctctggttgggattcctacggattgacatttctgtaaaggagaagtctgggaatcaaactggaaattctcctaatttttacacctcctcccccagctcctgattcatttggaagtttcaaagcagctataactggagagttctgaagattgatggaatctttgccttatgcatttgttttgttttcacaaaaaggaaacttgacagaggatcatgctgtccttaaaaaatacaagtaagttctttgcacagaaaattggcttaatgtaactttcaatggaaacatttgagattttaacttttaagtgcattcgagtaagtttaatttccaggcagtttaatacattcttttcagctgtgtaacttgtagtgtgttaagccctgctttcacccagtgtataaagggaaatgcacctgattttgactgattagtttttttaacctttcagcatcacgggggaagtagactgatattaacaataattaataatgtgcctcatgaactaaagatccgaaaggaatttaaataaaaatttcctgcatctcatgccaagagggaaacaccagaatcaagtgttccgcgtgactgaagacaccccctcaaccaagaatgcaaagcacatccaataaaatagctggattataactattctctctttcggggccgtggggtgggaagcgggggcgagaggtgctgttggtacccggctgcttttcctctgggaaaggatggcgcacgctgggagaacagggtatgataaccgggaaatagtgatgaagtacatccactataagctgtcgcagaggggctacgagtgggatgccggagacgcgggcgccgcgtccccgggggccgctcccgcaccgggcatcttctcctcccagcccgggcgaacccccgctcccgccaggacctcgccgccgccgaccccgaccgcccccgccgccaccgccgccgccgccgccgccgcggggcctgtactcagcccggtgccacctgtggtccacctgaccctgcgccaggccggcgatgacttctctcgtcgctaccgccgcgactttgccgagatgtccagccagctgcacctgactcccttcaccgcgaggggacgctttgccacggtggtggaggagctcttcagggatggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggtaggtgcatgtgtggttgaatgtgagtctgggctgcgcgttaagggtctgagatgcagtggttggagtgtgggtgggctgctcgaccaagggcgggcggatgagccagtgctataaaatcaggtttgtggcttccctccccatttcccctgttcagagctctctccctgccaaccgtactgtgatcattccttcccgccaaaactgtttgccttgcttgccaaccgttgagtttcaaagatccaggctttgctattcagtaggctcttgggataatggtatcccttcagtgtttttcaaactgggagtccaaggatccccagcattactgtacctggcctgagtagctccttgaaatcagagacagggccaactcataaactgacctcaggctgggccctgggaatctgcatcagaaataagcccctctgggggtttcttctttgtactaagatgtgagaaccacccaattagaagaacagactcccccagaagaccaaggtcatgccttctcctcacttggtaacatctacccaaagaggaaaaccaatggagcctatttccctgaaaatcttggatgtttgtgaaaaggtaaattgtaagttgactttccaaaagtccggccattccaagctgcaatgtgagccacattcccagtgggcatgacccattgtcttgaagaacactcatctatgggtgtttatttcatcagtggcagaatttgcattcgctgcacgctttgtgttctatttctataacttgtgtatgattttgaggtttactggaattttactgtcttacttttcaccaactagaattcacatcattttgggtcttctctgctggataaacgtgaatctacagtatctatataaagcatagaagaattgattcttagctatggattcctgtgctctgactttagttgaagtgattaatgcctgtatctttgaagaacatgtgtgagcatatttttttttttctggtattgtgctaggtagagccttcattatgtcaccataaatttctttttgggtgtatgattctttgggggtggggtacaggtcctaagactgaagaagtgtaattgaagtctatactttatatatctaaaattattaatttatgaaaaaccaagaaaaggaataatttttgtctgaagtttttgcagactttttgttttaatctaaacaattgtctttgaaaaaggatgcagttcagtgagaattgcatcctttattaggaggattatagggagaattactaatgctattattttatggaaactaacaggagcaaaaagcctagcagttactataagtggattggatttcaagatgcacattacatattttactacagtttacaaagtgtgctaatattaaggggccaaaaagagaaaaggccaagaaaagtagatgactgacatgaacatctgatcctacttgaccaaagttgacaaaatattgatgccactgttcagtgtttaaaagtaaacatccccatttcatctctaaaatttaaatgctttttgtgagttgtttgttttttgagatcccatactaccagatctttagtaattctggaagaatgcagtaaacggtgaaaagaatatttttgtaaaatgtttggttaagtaggtggttttatttttaaccaccataaccaaagaggtagggacttccagacgccaaagggatcattttaagaccaaagtaaagctaatttaacagttttattctttcatattttttgtgaaaaaatgttaaaccatttttcttcctagctgaaagaagtccaaggtggtaactgtcacatgttaagtaatttaatcaaaagatgggaagcagagacctatgtttatgatagaaattaagatataatcttgatcttcattgttgagctgtggtatattaacatctcgtacagttgaattttctttttgagtgaagactcactttttcctcctttcaaaatagagttttcttagtagagcctgtctttgtggtcaacaggtatctgaggttgataaatgtagaggctacattttatgatgccaaaccacatgacataccatagaacatgataaactttttttttttgacaaaacctcttatagtaagaataaatcatatagaagtacaaatagctgatgttgaaatatgtagttttcagaacaacacatagatggatgactaggtaggaaaacaaaggactttggccaaaaagtatatatacatgtatatatatcaggaagtacaatcataaatggatactttggaataaaagtaacagcatttgggagtctgatttacttatcctttcagaggtgcattattaatctaaatttttattttaagcatttggcatatagacaaaatttcctccagatttataccaatcagctatgtttcatcttacagtacagaggactcaataaggatggtgaagcttcagaagagagctagcacattcttttgtcatgggacgatgactctgactcagtggatcagctcatctactgaatctgtactaatgggggctttagacttgaagtcatattttttctttgctgctgaagaatagtttgcattccacgttccataacttggagaaagcagggccttggactgataggggtctgaaagatggtcccagaagcctacaaattaagtaaagactaaagacaaaattggatgtagagtggagtggggctttattcctcagtctgaagaaggcatccagagggagacaggacagcagagcatcgagatggcagcagcattaggagatgtctaagatcctactcttccaagtgtggttcacagaccagcagcctagacatcacttgggaacttcttagagatgcagggtctcaggtcctaccccagagcttctgagtcagaatctgtggtttccacatctacaggtgtgtgtatacacataaaagtgagaaatgctggccaccatcaccaaccattgaatcctgtgcatgtcttttaggaaaaatgacaatctgggatagatcctgtaagtgtccctttccagtggcctcacgggtccatagcattacatagaatactgcgtatttcctaggtgtccacaagagtgttctgacccttgaaagaaatagactggaatgaaagagagataggaaagaaatgattatatgccctgtcccctcaagaatgtttttcatggtagctttgcaatctgtattggccttactgaccccattaaaggaagacagcttttctgttccagttaaaagacaggaacttttactctttctatagctccattaggtatttgattctcttgtaacacagttcaaattctatagaagagtttagaacttcttcatgaccaaggggctcttgcaagtggtgggttgagatttgggtgagatgatggtgcctgaatattgatagcatcctccaaactgagaaatgtgaccaacatttttgcttcatgtcttagaagagagatgtctgatgattgcaagaatgagatgccttaaataggcagttggcttcattctgttgatgagatggtgctgtgactttttgtgtgtgtttatcttttggtctttgtggtttaggaagacaggaacttacttctccacatccagtagaggttagcttcctttttattagttggtcagcaagcagtttctcgtttctgtgtgttgtctacatccacccaaaagtgtgattaactggaaggtaataccattcttgggccagtgtgcatcatttttctagtggctgagtatcagctgcttatggccaattatggccgcaaaatgacaggattaaaaatagcttgaagatgatccagtcttcgataatatatttaatgatgaactttccttgggaaagtgcatctttctgcctgctaagaatcacatggcccctttcaataatttattttgtggaaaatacacgttattgcttttgcagtcatgtgctgttgagtgattacatttggggacttttgtaaaatgttatagttcactcagttctcttttctgttttagggcatttgttctatttagtatcggtcgaaaacatgtctttcttctgcgcatcctgttacttgtagctgtgctttctagtgagaactgattgatctttttagtaatccttgattgacctggaacatttcagattgttcaaatgtcattaggccacacagtgcaccaggtaacagaaagccacagattttttttttttttttaagccaaatctctttgagtttctctttatctctactcccagtcctagtcagctttttggaggaatgataaacccactcgtgaagcaggcatgtgggtgctatgtgtattaatagcagtgtctcccactcagagcacccccacacccacttccgagggcacccattgtgtcttcacaagagtttagcaaagcgatatttcagcagaagtgtatttgtgctagaaaaacaacactgtctttgtagtatgcaagtaaaaaggcttttttttcccccctcagagatatattgtatttgaggttcaaaggttctgttaaacctttttaaagtaatctaatatcaccttattcaggtatagcggtaaccttgcgagctggtcaccctttcccccagctatacacaggagaccactcagagaactgactccgctacgaagcttctttttcattcctcttggtttgattcaaaccaaatcagtgcttgacctcacaacaggattaacgatgaaagtcagccaaggactgagacagtaattcaaccaatgtgattgcaagtcttctgtgtgcccagccctgggttagattgggggtcagggagaaacgctccccccctctccagccctggatactctcataggctgatgctagagatgtccacgtgaactcagagttgccacgcaacctggtaagcatgattttaaactctcagatttagagggagaaagaaaaagaaaaaataaaataaaataaaaaacttaagtatgtgctattttgcataaacttccatctttgtctgaaaaagttatttctaaccatatggctcttcatgtgtgtattaggcctgatttaactaggaggagaaatagttttttaaaaagactgtgttacacggacatacacttaagagaaccgaaaggcagggggagttcccttgttaaatatttaccctttgggcactccttatacatattacgaagacttaataaacactaatctgcagtttttcaagtatttcattaattgtttcaatagaagacaatcaaggctctgattaggatgagtagaatagattgctttgaagaaatatctttcttaaatccttctggtatgcagaaaaatacgagttgatctgaaccagaacagaggagagaggaaaaaacaaagcttttgttttggtttggttttaggttctagtagtgttctgtttattaagaggcttctcttccaaaatgcaactcatagaaattcccggctcactgggacatgtgtgttcccgaagtgcaggtgtttactgtctaacttcttttattcgtcggccccttctttaactggaggttgtaaaacttttgaaatcacaacatagctgttttcattttttaaagtatttttttgtagatcgccacttgttctgatctgtgctcacctctctagtgccagcatgatttctctgctctttatttgccagacaaaagagaaacccagctgtctttcagtgagcatgatgctggaatgattgtttctatctctccaaagccatgtagaatttctcatcaggaccactcccacccccgaccagggtcccccacctgcccatcaccccagcacagggagacctccaagggggagctccttgatactcaccaacatgggtaaggtaggactgtgtctacgcaagagcgttgtgtctaggtaaccagcaagagggagcagagaaggggtgggtcatagctagaatattatgacccctgctccagtcttactacaggcagccgggcaaggaaaaattctgtcgttagatctgatgctttccttccagagctcataaattccagccctatgcaggggataagatagaatctgctagaagaatttgtactagctctggtctctgcagtgttagaggcgagtgagggttatgctctagcctaagataaagtttgactaactaaacttaactaaaatcacttatactaaaaactgctttcccagatgccctcttaaacacggtagaaagggaatgtccctgacctgctggggtggccctttgtagcagtgcaccaagagctccttgggtgattttcttacgtgattggctagattctacgagaaagttcgctggtatttccattctgctccttgttttgccttcagactttcagggatggagccatattccatttttagttaataatgaactctctggggcttcaacataatgagtcagaggcttatgccggactccactctcctctttacttcgtctcctgaaagcaacccaaggacccacagtgtcaagtgaagcttacattttccgaaggagatttcaccattgagaccaatacttctttcttgtgatggttcgaattactacatttttttctgtttttaactgtcttgtcttaagctgcaaaagaatatggggagtttatgacttggggaatgcttggaagaccaaacaaagcatcagtgttgcagggtctctcttcttgattttatccgactcttcctcaccagcactaaaggtttcttctgcttttacagaacgatgaatgtcatattcatgtattgcctttgaaactgaattgcagccagatattccacccagctgcattagaattttcaaagcgaaaatacttagtcctcttaattcaatgccttctgacaattagggtaggaaaaaattaattacaaattatatcaccatctttagatattgatttttttatctcttggggaaaaaaagcaagtccataaaggatgccaggtggcacctctaagtctaaatttttaggactacgtcctagccattctctttatgaattcctgctggcatttctctctctctctctctccctttctctttctctctctctttctctctaacacttaaaactttcaaaggcagttttgagctatttttaacaaaattttaagtatagtgaggcagagcctcttactaaatattaaagtgactgtataaaaagaaaacaatgggaagaggtcttaaggaagacgagcaattgttcgctaatcttaactccgagttcctagcaaccagggcagtggtgggagaataaagatcttgttattttgtagcacatgcacactacccttttccattgaaaaaacatttattgggggtctaccatgtgcagagttctatgccaggtgtttcatctgtggaagaaaacctctgcctctaaggaattagccaaccagtagtgagactgagatgtgtaaattgctgtgatccttgacacactttagtgggcggaaccatctggtccagctggaagaaggggatctggatgagttttggtgggagatatggagagagggcatttcaggtagctggatgggcctggaggagtcagagcaggcaggaatatgtgaggcgtccctggggacttggaaagagtctgacgagattggggcatggagatttcttgtgagaaaagactggatcgtaagttgagaggtctgtgttgaatttggtcgatgttaataggttcttgaaagggttctgagacaaggtggggtatgtaggctggtggaagattgacagtggctgaggttggatagtgggagaccaaggaagaggtttggaccagggcagggggagtggggatgtggaccccaaggactgacaacagattgaacatgggaaatgagggagggaaagaagcaaagaatgcaaattccaaacccaggataagaaaaatgaccgttttgtggggtaaatgtgatgaaattcattttggacattttcatcttgagcttcccatagggtatccatcggaaatgcccaggagcagttggtcttcaggatctagacctggagagagacattggggctggaatacaccctgcttttcccccaaaccctgtcaactccccccttttcttcttttgtttccaaaaatggtcctagctgctgctgctgattctgccttcttttattaaccactctttctacaccacctttcccccaaagtcctctgtagaggtctatggattgaattaaggtgattaacttgaagttttactgttcaaagcttggctccccactaccagtttgcctacttaaagataactcaactggagttagattactgttgtttcaacatcctagtagtgttctccgtttgcagattcttagacagtccaggagttctcctgcactggtacttgctgacttaatagcagttctcctagtatattgaacccgcacctagcatagtagatagtaggtgcacacaatgattgttgattgaataaatgaattaataaaagtgataggatagaggccctttggacatcaaactcatcctctccactcattatatagagtatatatgttccactctctaatgttccactgtagggacatatgtgttcccactgacccatcctatggattctgttaatattcagtagaagtggacaaagaaaactacctcaatgttttgatttcatcctttatcattgaattgaaaaagtaagtcattcatacctgaaaagaaatcttctagattttgcttgatcttaaacattcaactttaatgaaagtcctcactgctaatatgagagattagcacatctctgatcacattgtatctgtttgtacaaaggatacacgcacacagtcagacatatatgtgcatacttgctctcatttctcgggttttgtgtctccagccctgttcagacagtcagagccttgtcatctaaacttcttcattacctcatcctgaaagaaagcagggcttgtccatggttctcacagtgggggacagagtggcttttcctctgttattagtattgtaactcaaatataaaagaactatagcatacaagtcacaaggataaatggtcccctagttctcctcccctaaaaacaagtagccaattggagatgggggtcagtataactcggtatgtccagagcagagggatgctgggattttatttctccagacactggccaatgggaagattactaggagtggtatggagcaaaccactgggctgacaggtttgggctccatcctctgttctggttgaagcaagcatcacagcctttctgtggtttttaagaactggtggaatttgcattttgagaatccttattccttggcatgaagcaaactcaaaagcatcgttgctcatcatttgtcatctgtttgaaaaagattatgtgatttgtgcacttgtcatgaagcttgaccatacttctggggcttacagatgtgagtccctgtgaaagaaaccacaagcaaattctcttttctcccctatctttacttcttccctctcgtttcttcaatggccatctgtgcattatgttaccactgccagaccctcttcaagtggcttatctatgagtgaattcagaaacttcaaattataaaggacacccagataattggcccgttctccagagtatctgtcccctgtgctgctgccagattccttcttaatgaatacatccagtgacagtgggattcttgatcctccggatccgtgagaaaatgagcttccctgctttgtaacagcttgcagctctgggggaaaaaaaatgacagccattgcacaagtttcctttgaatgtagttttctttcccataaatgatactttgagactatacttaaggggttattagttttctatttcatgcttggcctgtgtgtgataataacacaagctgtcactgcaaatcagcagctaaacacgctctgtctggttaatgcgagcatttcatatttggctcaattaaaaattaactgatgaaagtacatgtcaaatggaatttgaaaataccttttgtagggaagattgaaagggcatggccaatgagtaaattagtggttttcaaatgtgaggattttggggacatttaatacgagttgggacacttgactcttctctcaaatctctctacctgtttgaaaaggatgttcccatccatatcatgaagggctcgattgcatctgtgtgtttactggaaaataattgttgtgtgtgtgtgtgtgtttgcatgcgtgcttgctggatcatacagttaaagcagatagaacaggggatgggggactcctctatctcacactttgtttttttccattggcagcatgctatgggccaatgtggggaggtaggagctagcttagagtctgcaggctggagatcatgaaacagcagctgcaggagagcctgggggaagctgggagcaaagaaacgcaaccacagtaggggcatttactggagttggggaagtcttcccaggaaagggagctgaagcctggaagctgagccaaaagtaacctagggctgtggtaagaaggagcagagtgtggccagcagacaggacatggagaagagggaccgggggctccagagcatgtggggagttgaaggaacagaggagtccagcctggctggagtgaggggtacaggtagggtggattagaaaggtggccaatagagttgtaccactgtgtgtatggggggggtggtggttattttagagaggtccctctctatttgctcagctagacaggtgatattagtgacaggtaggatgctagctcagtaaaggtgatgtgtgatctcagtacccagaccagggattgaatccaggctgtttcaatgaaagcactgtaatcctaaccactagaccaccagggaactcccaagaaattgatagttttgtgcaataatcaggactggaaaggagagatttctgggaagatgtagtgattgactgaatgctttcaaatcttgctcatttctttttcagttacagtggtctttttttctgtagccactttgaaaagaatatgtttggtcattgttctggttatacacaaattttttttttaagtttcccattctcttaaattaatacagcctgactgaaaacttgattttgttggaattcacattgcaataaatcttcattaaaaaccagttaatgaagatttatttgaagaaagaactcaactatgaaagacagttttcacagaattttttcctaggttaaaaaaaattgcaacagtagtgtcttgttttgatggaggattttaaagtttccgaaggaattctggatcttttgacccatttgattttcagaaaactctaggcaaggcaggtattatattcccacttctctctggcttcctcttcccacaccctttttgttatttgtttatccccatgtgaagagaaaacctagactaacaaagccacatgagagccagtaagtcaagaggagcgggtgttcagtgccagacccggagtccgggagatatttcttaatgctgtgctccttcttggggcatgttttcataaggacactagattcctcaatagaaacctaatcaagtttatgcctaattttaaaaaatagtatccctaactgctttttatcgcaaagatttttcaggaaaattaaaatgtaatcttgcatttcaggttactttctctcctttggtttagcttttgaaatgtgtttcatcttaatggtggagggacatctaacttcgccttatgatgcacgtggatgtgactgtgaattgatcaaactgggcacacttgaccttgaaactccttctaaggggatggtagtgtcctgggtaagagagtttgctaaaactcatgcgagggttctggaaaacagctcctttcagcaggggtcaagtggaattatataaacataaatggctgtttctgcctagggatctgtgtttttatttactttaaaaattggaactctgggagttccctggtggcacagcaggttaaggatcccatgttgtcactgctgtggttggcgttccatccctggcccagaaacttccacatgcctcaagcatgatccaaaagaaaaattgagctcctgtctttaggtatccaatataaatttggtgagtgaagtgttttttgaactgaaaaaatggtggcactttcatctgtaggatttccccagtgtctaaaggacatatgggtatacatttgttcaactttgttcattcaacagataattgtaagagtgctggagctatggcagaaacatgacagccgtgaactgtctcttgtacctctcgtgaatccaacattgtggagaaatcagaacagtaaacaggcaaataattgacaatataatataggggctacaacataataaaaacaagggaattcaatacaggagtgctgatggggcagtattaacgtcttacatttgttttttaaaactatagttgatttattatgtcatgccaatttctgctgtacagcaaagtgacccagtcatacatatgcatacattccctttcttatattatcttccacatggtctagaccaaaagactggatatagttccctgagctatacagtaggacctcattgcttatctttattttattttatttatttattttttgtccctttagggccacaccatatggaagtttccaggctaggggtggaatcggacatgtagccaccagcctacaccacagccacagcggtgcgagatccaagcagtgtctgcaacctataccacagcttatagcaatgccggatccttagcccactgagcgaggccagggattggacctgcatctcatgaatgctactcagattcgtttctgctgagccactacaggaactcctcattgctcatctttatagtcttttttcttttttggccaccctgtgacatatggagctcctggaccagggatcagatcaagctgcagccatggcctaagctgctgctgtgacaatgccagatccctaacccgctatgtcaggccagggatccaacctgcgtcccagtgctcccaagatgccactgaagcggaacttctgtatttgtttttgggttcttccaatactattgctgtttgctcagaggagtttgaatggatttttatttttatttacttacttttctggccacactcatggcacttgaaagttcctgggccagggattgaacctgctgcagtgatgacactggatccttaactcactgagccaccagggaactcctgaatggctttttaaaaattaacaacttaaaacatagtgtcctaccttaaaatttaaatatagattagtataataaggcccgtacatcagtttaaaaatgggctactggggttcccattgtggctaagtggaaacgaatctgactagtatccatgaggatgcaggttcgatccctggccttgctcagtgggttaataaggatctggcgttgccatgagctgtagtgtaggttgcagactgggcttggatcctgtattactgtggctatggtgtaggctggcagctacagctctgattcgactcctagcctgggaacttccatatgccatgggtgcagccctaaaaagacacatacacacaaaaaaaggtcatttctcttgaaccacaaaaaggctagcatgctcaccataggattaaagatgacctattttaggctaaaatgtttggagcgctttccctattatcccggaccaatccaaccatattccccatgtccatttgccacaacattggtcattggcctctgctgctgaagttagcagaaaggaaggaaactagcaataattgaaccccactaggtgccagatttggggcttaacactttatggatagaagattagttaactccagtaacctccccctgagggtaggaagtggaattatagacgaggaaacagaggttctgcaaaatcaagtaacttggcctggcaagaggcaaaagcagatcctttttcaggcaatccaagtggtaactgatgtcctctgaaacatcaagaaatttttaaaaatttaaaacacaaacctattaaaagtaacaatttggtgcatgtgatgttttggtttcttttgtgtctctttaggaagtccattagccttctttatctcagtaactaggaggtaaaatctcttacaatgtggactttaaaagttctttcctagtttaaaaaaaaagagacacacacagagaaacaaaatgcttctgtctctcctctttggctccaatagtctgtataaatagcctttgaaaaataagtcataatcacttcttcacaccaagaccagacacctgattcagaaactctccctggggtaagtgtgtgtgtgtgtgtgtgtgtgttggaataacacacccacagtgctttcccgattcaagagaaatgatctcactgtccaattgttacctgcctaatgccttaatcaaaaggtgggaaaagtctgcggttttacccctggtgtgatcctcagccctcactgttcttattttaggcatgaccttagtgttttttccagagtccagaggtggaatgacatgttactcaagtttacaagatgatgatgtatctgcttttatatttagctgtaaattttattctactcataaacaaacccaccttcggtaaccacggtgcatcaagggacagttatttccattccccttggtttaatttggatacatttggcctagaacagcacagtgtttccataataacatctgaacaggatgctgtgttgatctgcagggctcagggagtttcagcatgggccaggaaactactttcttaaaaggaacttaaacatcaaattctgacaaggtaggaaactcttactagtctccttactaaactctcttttttccttcctgcagtcttgttaattgttatatctcttggtgattattaaacacatatggatggaatatttaatcttaggttcatgtgcagagttaagtaactcaaattcaggtggaaaaaatattttaagggatttgtttaatcaagcatatacaaattaaaaaatttcttcccagcacaacatgttataacttttagagtggaacttcatggtatttcacaaggaagcaaaaaaggaaggggaatttattcaggcagacggacaatagtaacctttcattaaatgagacagagttcaataccaaaccctggcttctgtgtttattgaactaaacacaccaccagctatgtcccttctcttttacagaccagaccgctttaaaaatattggtccaaaaaaccctaaactgtttaatttataagatataacccaacagtataatatctgcaagattgctttatgtattttttataaatccttaaaatcctaatggcttcaggtaattaggatctttgctcttttgatggttaaatatgtgacgactgagttgtctggcttggtctcaggacaagagaagggtgggtttgggttctgtgcccaggatgggctccctggtttccagcgtaaaaagaaggccccgcccttcctctgccccctcccactcacacaccccctccctgggatgattcatagtgtccacatggaaatgaagaggacccatctgtcaccagtgttgtcatttgtgaataaaaagcctttatggctgcaaagcccattaacgccctcagaaatctctgtttaagcaattatggtgatcctcaacacatctaggaaggaggaagtaatttccacccctgctatgcagaaggatattcataaagctcacgtgccgaaggtcatacccattcctcattagagttgggccatcattcttaacagctttgctttaaaatacataaacatatataatatgaatgtgggtgcatgtttatctgataaacaaaactgatataactaaaacttgcagttttgaccatttttttttttttttgtctttttgccttttctagggcgggctcccacggcatagggaggttcccaggctaggggtctaaacggagctgtagctgccggcctacaccacagccacagcaacgtgggatccgagccgcctctgcgacctccaccacagctcacggcaacgccagatccttaacccactgagcaaggccagggactgaacccgcaacctcatggttcctagtcggattcgttaaccactgagccaccacaggaactcctgaccatttttaagtgcatcttaagttcagtgacattaagcacattcacaatgttgtatagccatgctcaccatccatgcccagaacttttctgtcattccgaactgagacgctgtactcattaaacagcaactgccctgttgcctcccacctacctgccaccctccaggccccggtaaccactattttgtcttctgtttctatgaatttgacttctctttgtatatcgtgtaagtggaatcgtacaataattgtccttttatgtctggcttatttcacttagtgtaacattttcaaggttcatccatattgtagcaggtgtgggaattttatttcttaaggctgaagagctttctatccaattcaaaaaatccactttctcacaagattggttatcatgtcccccagccaacagaaacagcaaatatagttcattaggactgagttggcagaggagacctgcagattgttttaaaattgattttcaaagtctgactgctgggagttcccgttgtagctcagcgttcacgaacccgactggtatctgtgaggacaaagattctgtccttggccttgccagtgggttaaggatctggcattgctatgagctgtggtgtaggtcacagatgcaacttggatcctgcattgctctggctgtgacataggtcagcagctgcagctctgattggacccttagccagggaacttccatatgccacgggtatggccctaaaaacaaaacaaaacaaaacaaaacaaatctgattgtcaggaagaagttaaaaatgctattaagactggctcaggaactgaaaagcacagccctctgaggcacctctgtgtggggcagacagtaatgaagatctcagctgcccttgaggttatcagcgggttgtaagcctcggacagtcttactttttcctaaggatgttgctgagtcatcaagacaggcctgttttccataggaagagttgaagagttcagagaaagcgggtaataagtttcagaaatatcttcattccaaatggtcaaaaaaaaggtgttttttttttttttttaaagtttaggcttcagtcatctgaaaaatccacttcagtgaaatgattcattccagagggtgaacgagaagaagcaaagcaagagtagtgtaaaataaataaataaataaaataaaaatagaacaaaagactgtccgtgacctttacttacctgttacattccatttcttcccctacctcacttttttaagtggagaatttttaggaacttgacccaagtggatatggatattgtgatttcagggggattttttctgtattgctctcacctagatcttcctctcagtgcctatgttacattgtttgaatatttagaatagtcatgtgacagtgtgaggagctacgttacagtgcattagctcagagcatctgactctgaatgtcaatttgaaaacatcgtaacgtaaagtgtggtccttagctcattccatgttctccatgcctgctaggcatctggacaccatctttggcctcgcggagggcagtctcctggggagacagaaacacaaatgaatatgacaatccagtgagttttttcctgagaaatttaaggatgatttcatagaggaagagccatttggcctgggtcttgaaggatagttgccctatggagaaggggcaaggctaccatgtgcaaatcagcagtcgtgagaatgatccagagggcagcataaccagagagaaggagtcctggggtgaaatgaaggagctgaagctgaggggacagtcgaggctgactcactggccccaagtgtctccctaaggatttcagatttgatcttccacacagtggagagccagtgagggtttctagcagggtggtgagtgtgtgtgtgtgtgtgtgtgtgtgtgtgtgtgtgtgttggggggaggggaagatggggcaggtgtctttcttggcacctgccctgtacacctgccgcatcttcccactgaggtggaacaattgtgaaagtcacttcaaaagtagaatcagtgaagtctgtaggagctgaggaatgtggatatgatctgcccatccctgaatactcagggcttagcatgggacaagcacaggataggtgcccagtgaatatcggccaagtgactgaatgtatgagagtggcctgttccgacctatgaagcagtaccagtggcattaaagggtgcccagctgtacttgggataaaccaggtgttcgcagggcacctgctctgtgccagacactttctaaacgttctgtctcccttaacacatttatctctatgacagggcaggtgggtgtggttttatccttgtctcgcagatggagcttggagaggtgactaattacagttgctttggtggcagagctgggatttgaacccaggcatccctggagcacttggtgttcttcgtcacagcgctttgtcacctcccttcccctggagtttccagaaagctgcttttatcaaggcctcagaaatgatgactcggggcaaacataaccaggggcaggatgcagagaagcctgtttaggaaaccatttatctcccgtagacgtaccgtctgagatgaccttagtgaaataacaatgcaataataacagtgctacagtcttttccctggcataagaaaccacttttgtcatgaaaatggaatttctctgggaaatcgtcctagaaagagataggcggctgaaataaaataacaaaaaatgtgaaatagtatcaaattgttttctgcgtgttttccctcctccccctgcctgcccagtagtgtcatttactttgttcacttaaaatgtacagcctgggtccctcagtcccaaagcaagagaggagtgtgtacatccagagaggcctgcgacacacctggctaaagggagaggggatccattagggtccattagggtcagcattgctttcagggtggaagcctgtggttttctggaatgaagggtggtgtgtgtggtttccccggtggcccacgggctggaatctgagctcggcggcgttcaggtgtgtatgtcctggatcagtacacccccaactgaagctgtgttctcaggccataggtcagaattgtctaaaataaactcttgtcataacaagggaggtggcagccagattacatctcagagttcctccatgcgttcactccagaggacaccaattttcctgtccttgtggggaaggattccatttttatacggattctaactaggggtctgtcttgctctcccaccctcacaaatggtgatacatggtggtggccatagcagcgtggagagagtgcagcctggaaacccagccaagttctcatggctctgattttatacaaatttgctcaatagaatgcaaatgatttcatagtaatggggacccagggacaagtgttcatctgtgttcagccctctccttgggcttttggcagcagccacttcagagataaggacagatctgcatagggccatttaaagacggtttgggaaggaatggctcacagcaccacagagacctcacctggcttttcagcagccctctggcagcccgagaaccaagacttctgtgttttgagaacagaaaaggtcaacatggatgaacgccttttaaagccctttcttcctcttcttgtcccgaagatgtcccatgatcacagcatacatcctaacacttaagcatcccacacaatgactgggcatttgctcactacaaggcagggtcctagtcactgattaaaggctcatgtgggccatcaaagtgtggaacccaaacgccgtatccaaaacctagtcctgcactgtccagtatggtcagggcatgtggaatgtgcctcgtctgaattgagatgtgatttgagtgtaaatacacaccaagtttcaaaaacttagtatgaaaagatgaatgcaaactcttcattgatcattttcctgttaattgcatgttgaaatgatattttggatatattgtttggaatgaagtatattcaatgtggctactggaaaattgaggatgacacattatatttttattggacgcacctggtctagactgctgaccctttattacacagcgtggtcaccttttaattctcctatttggatattattgtagaggagggtagaaacatcttttcttttcccacagatggggtacggtgtagacagtttcatggcacattgtgtaacctcacaaagtgtgttcacaccaagtttatagttgatcccactgtcagtccactgaggtagagaggaaaggcctggccaacacttttataggtatttttcaagtataatttctatcacaggccaatgcctataagaaataaactcaaaattacccatggaaatattgacttgtgtttctataccaaagataatagactgggatcctatttagaagcaaatatgttcatgtcttgtgtgtaaatagacacagccatgtcctgtagccaaatatgaagcattcatgaaaggttgtggctgatgtgcactggaaaaatatgactcccattgaatttttggatctgtcaggtcacggggtaggggagggttagggcatgttgtcatgacaaggggatctttcctttgtttgaaagttagctattgtcatgtccaattcctgacagctcaaaacgaggttgattgatctcaacctgtcagaaaggctcgaggttgagtttggccatccaggggatggaaggatggacatccaaaggaaggaaggacaaagcagaaccctggactgaagaggcatgggatcagatccaggaattttactctcagtgcttctgacagcaaacgtgtgaggttttctcacaccaacaagcaattctgccaatccctgggcatcagctgggtgtcctatacttgaatcaatgtggatagtaactccaggtggagtcagcatcagatcccatacattaagggctcagtcccacaagactgcccccactttagacactactcaaaaatctcagccacctacaggttcctgtaaccccttcctcacgctcgataatttgttagcacagctcacaggactcaagaagattgcctgggagttcccttcatggctcagtggttaatttgcacaactaggatccaagaggatgcaggtttgatccctggcctcaactcagtgggttaaggatccattgttgccgggagctgtcgtgtaggtcgcagacacagctcggatctgatgtcgctgtggctgtgctgtaggccggcagctgtagcactgattcaaccccagcctgggaacttccatatgctgtggatgaaactctaaaaagcaaaaaaaaaaaaaaaaaaaaaaaaaaaagaaagaaagaaagaaagaaagaaagagaagaaagaaagaaagaaagaaagaaagaaagaaagaaagaaagaaagaaagaaagaaagaaagaaagaaagaaagaaaaagatactttactaactcaggaacagccaaatggaagagacgcacaggggaagaggcctggtccttccttgccctctctaacagtgcccctgccagcacttcaatactttcaccaacctgattgccccatagtctaggggttttaatggtagtttcattatgtagacgaagttgatgaaatcattggccattgtaggaactcagtttctagctcccccactctgatcagttccaacccctgatcatgccttgccttctggtgaccagcctccatcctgaagtgacctaggggccccaggccccagtcatctcactagcacacaaaaaatactcatcactggatgtcccaaaggtcttggaagcccttgtttcaggaaccaggaactgttaccacagatgcgccctcaccccatcactcaggaagtgacaaggatttcaggagctcaattccttatttatgccacaaagtcccacactcaaaactggcaaagaatggagagtgcacttctagagcaatgagagaagctgtcaaggccaagaccggaggtgggtgcggccggtgagatgagcacagctctgagggcactagagccaaaggccttgggttgtatcctcttggttctcccaggaacctaccatttgggcaagctgcacagttttctgagcttcagttttttcacctgcaaaccagggagttgtgttaaagtgtctgtcactaaaattttgtgattctgtgagttttgaagaccagagaattggcaggtataatattaatgttatctatgatagcataggggtgtgcttcttactgctcttctccttttgtctaatatactggggggcactgagatccatggtaaatatgatcattgttctggaccattcatttggccctgagtgagacaggtgttgaagccagaattcccttgcagctgtggccagtacacacgtattatagcgtaatatctgaaaacatgtatatgaatttctttcttggctttcccttttttcctcatctgtatactttctgtgatttataattatttcatatcttgagagtttaatattacacaggtagcagtttctccacatggatcataggctttagtaaatacatgctgttcttgtctacaactgttttctctaccctctcctgcctatggactaaaaaatttctgggccatagatgaacaccataagaatttaattacacttgtaaaatttttaaataaggacttgcaagatttgttataaaaccaggaattctcattgtggcgcagcagaaacgaatccaacaaggaaccgtgaggttgtgggttctatccctggccctgctcagtgggtaaggatccagcattgcattgctgtgacctgtggtgtaggtcaaagatgtggcttggatctagcattgctgcaactgtggcataggctggcagctacaggtctgtttcaacccctagcctgggaacctccaatatgcctcaggtacagccctaaaaaatacaaaaaaaaaaaaatttgttataaaaccaaagtagtcaagacaatgtgttattggtataaggacagacacatagatcagtgaaaaagaacagaatccagaaataggtccatgcatctacagtgacttaattttttagacctgtgccaatgaaatttagtggagagaggaaagtcttctcagtaagtttttctagagtatccagacatctatacaagaggacaaaagtgaagcttgaactctacttcattctatctacacaattaatttaaagtggatcctagacctataagtgaaaatttaaactataaagtttaagaaaatacaggagaatatttccgtgatcttgtgttaggcagagatttcttagacaagacacaaaatgcactaatagtaaaagggaaaataatgaatgagaacttcatcacatttgaagtacaagttattttaaggtggccctgacaactgatttcagtttttgactatgtttttctttttctttctttctttcttgactgtgcctgagacatgtggaagttcctgggccagggatcgaacccccaccatagcagtgaccttctgtagtgacaactctggattcttaccctgctgcaccacaggagaattcctacttcttttttaagatgatattttaatggcttttagtaggcatggggagacaaaggccttggttcttagatagctttgtatcttgtggagaatcactccaggagcacatgcctccatggaggggcccagccacctcgcctgccttgttctcctctgctcagcaccaagaagcctggcatcgtttttgcgggaatgaaaagattggcagagctgccctagatgacagccctgcaaaacaccatggcagaaggtttggtctacataccaaggcagccagcgtattaattgcattctccgtgatcacaaaaaaggcgctgaattattctcttcatgttttaagaatgacaggcttttgctctgccagctctaagcatagtgctatcacatggaaaggagatgctagatgtgacttaaaaaaaaaaaaagtgtggacgtgacgatcactggtaggcaggcagcttgttcttaaaaaagatctaaagttgaactgtttcataatcggtacctgcaaaaagattaggagcctggtgaggaagtgtttcataaattgacttgagctatgaaagcgttttccatctgaaatcttactttaaaatttgaaatgggacttttcaagttgccttgcttctgtgaagtcccattttcctttatgtttgtgcgtggactggaggagaagtggtccaggtgatttctgtccttatcttccccaaggctctgttcaaacacattcatgaatgttctgaatatccaggtcctgcagacacactgtgccctcacctgctgtcactgtttgaaccggttgttccctctgccaagggcatcctgccttcagagcccgtgctcacactcactccgccctgcacaggcacgttttctttctggtcactctcatctctgaacctggcaaggctatttcgttgagagctgtttgtgatgattgaacttggttggggggagagtagagaaagcaggtgtcagcctgtgtcgtggggattttcctatgctgaaaattgttattctgtgcagcaccccaccctcccctctcaagccccaaaaaaagagaagtacgaaggctgctgatgttcaaagcttgagtatgttttgctttaaaatgttcagtagatcagaggacatttcattctgggcagtgaagtctggagaagtattttgatttcctatgattaaacctcgtcttcccttccttctcatcctggtggctcgagtaaggtctgacaggaggtggggggagacgggcagccacggatggcctggcttggctctgatgggggcggggggctgggtccggccaggggctggggccagtgggtgcatatgtcacatgttcacagaaggcttggagcagagcatgactcctccaaacttccccatcagagcgtacccccacccaaagggagattcgagcagccaccgggtcttggtgtgagagccattgttgacattccttgtcacctgcaataagagggagatgcccagggcaagagggtcttctgtctgtgggctgtttgcctgctacaggcggtgcagcttgcttttcttttctagagtgagctgttaagtgagtgcttcactcagtagaaccttctgcaggagaaacatttcctgaccgtccctcctaccaccaacacacacctatttcactcagtcgcagagaacttttaagccagtcctccgtggtgtatctcgtggctgaggaaccattcattcactgaggaaaatggtcctgtctttaccttctttcaaagaccattccatctgctgcccatttacagagcacctactatgaacacctgccacacacacctcaacccttctccttctgcgtgtgagccctttattatctctttgttatcagactgcaactcccagcctagaattgtacatgtaagtgaaatatagaacgtgcagttaaaacatgcaggttacttataaaatacattgcacagtctagaaggaacacccttctcaaactgtgtattttgtttcagtgttcatcttaatctttattgccatcctttcatatctaagatgactataaaatttattgtccaagctgggatgcttgtgagagtgaaaagaggtgctacgaattataactctgggatgtcaggataaactggggtagtcccaggctaattggcacctatagtaacacctctgggcatatccacctttttgaaggtttggacatgattttgggtgtggtgtgtgggggggggcgcttgtgctgagtccttccagcatttttctgaaaaccaaataaacccctttgtaggtttctgtgtcatgttaaatcacccctggaatttattcacaagaactactttggttgatctgttaagtcttttactaggttttgtctggacactccatttccacgctcaggatgtagccaccttgcatttgcccactgcatcactctcctgtgagttcagcactgctttaaaggggcttctagccttcttggactgtgactggacttctttcccatgggatttttctcctatatgaatttgcttctttgtttaggagtctcagaataggaggcagagacataagctggactctatgtctaactgtttcagtaaggttgtcttccatctttctggtatgagaaagaaatgcacctaaggagtcctttcagccgttcttttctattttattttatttatttgtaattattattattgttgttattttgctttttagagctacacacatggcatatggaagttctcagactaggggtcgaattagagctatagctgatggcctatagcagccatggcagccagatccaagctgcctctatgacctacaccacagctcacagcaatgctggatccctaacccactgagtgagcccagggatagaacctgcatcctcaggaatcctagtcaggttcttaacccgctgagccacaacggaaactccagttcttttctattttattgagggaaaacaaaagagtactcatgagtaccccagccttgttagtgtgacaaaaagcgttccaaatatactaagtagttctgaggttatttgctcacctttgtgctattgaatgtgcctcagcttgcacttctatatgttgggataggaattccttgctttaaattgcaacctccaagaggatgggagcgcgtgtttgtttcactttctgcgaatgatgcccgccatgagactgtgaatccattgacacttgatgagtgttgctttctggtgctaagtttgatctgttgacaagcatcaggccatatgtgacagtgactgccctaaactaggtaatgttcccatcaactcggttttgtgagtctttgataagaagttatgactttttgaaaaaaggtagaatttttttgtaaccatgaacttccatctgcccagtcaaaataataatacatttggaggacaatttagagattctttcaacaaataaagaagaatagaaaccaagcaaatgtgcccaaagaatttggtactggaagaaaatcggcttcatcttactaagcaactcttgtgaaaagcttatccattttttgctttttttgcacttttcaatctgcagctcagttaggccacaggaaaaggatggtgtaccttcaaagagccggttgagttggccaggttctttgtattcgtggaaaacagctgtgggtgctgagggtaaaagtcaggcttttgttccatgcaaaggtgggaagattcagtcttgagacgtctcgttcttctgtggaggaggagttggcagatgttgagctgctttatcgacatcttcaaggcgtttgaaatgtgttgataatgacctgggaaagagacacgggcgggatgacagtgggagtaggaaagaaacattcgtcctacacagtactcgcctcttctcttgttttttttgtcggtggtgtggctgcagattaaatgaattaggttatttgtttccattgccttctaccaaatagaagtactggtataagccctccattatttttttcctgactattgaagcataaattaattctgtgaaaggagagctgtccagagcaatgagttctgctcccctcctctcatgctgtctctcctgtgagatgccagcaacggagcttctccagagcttcgttataaaggattgcaactacgtcccttatgagtgaggggttgaggtgtatgcctcgcttcaagttaagatcaagctttaggtattctcttttgctttgaaaaacgtgttcggggtgggggggcgcatgttgagtaaattgcttggaaggtcctttgatgctgctaacctgacacagctctctgtctctctgtccctcttttcttgcctctcttgtgagtgacctccatccccacagcttgaatctcacttgtattgagccacatctcagatgggtattgccacccactccaattctgcttgtctactatttcctgatgaacctttccacctggatttcctgttggttgctcacattttacgtataattaaaatatttaattcaggactaaattcatcattgttcctccagtgctttcttgggctcaatgatttttcttcatgtgaccactattctcctggtcacccaggttcaaaaaggaggccgtgtcttcccagcttctgctcactcaagtcagagttccttctttccctcttcattttgcacccctgactcttgtctaggcaattttcttaacccactccactttctcctcactccagtttatcttatgctttgtaacagatttgattaaaattcttacctgattaaaaaaaggctcctcctctcctgcaggataaaggatgctgctccttaagacccttctaagtgaattttcaatccttgctactcttggacatgatttgctactctttcaacccaccctgtcttctctgctctgggcatcattttttttcctgctatttttacattccagaggctctgcttccatccaagttttccaaagttccccatccctcaagacttagacctcctggaggaagatgttccttcctgtttgacgtgacccctctgacttctgtatctctgccccatccagcccttgttgtgactctcttcaaagcttcatgacatgctctctgatatggctttcatataaaatatttgctatccttttctttctcccttgccaaggttctaaacttgtttctgtcttctgcttttctgtatctacaactttgcctataaaatggtcttgcacctgttagtgctcaatgatacttgctgaatgaattaatgaagtatagtggctttgccatctcttatttaaacctgtttacttctctcctttcttcattcattcctgtgtgtgtgtatgtgtgtgtgtgtgttttttaggaccatacctgaggcatatggaaatttccaggctaggggtagaatcagagctgcagctgccaccctatgccacagctacagcaacgccagatccaacccatgcctgtgacctacagtgaagctcactgcagtgctggatccttaacccactgagtggggccagggattgaacctgtgtcatcatggattctagttgggttgcttattgcttagccacaacaggaactccacttcattcattcttccaatgatcataaattaagaacctgctccagtgcaaagcgtgtggattcatcagtgagcaaaacaaaatccctgcccagaaggtgcagcttctttggaaagcaaaccatacttgcttcaccctcttggaaaaaaaaaaacaacacacacacacaggaagcagtcattttaaatgtgattaactttatattgtgttgttctgtgattaaacttggcttccacgaagactgtgcctttttggtagttagcaacttttgaggatctgtttcttaaaattggctccatagcccagtggctatcagatgttgaaaactctacttctttgacctgcctgatggtgaaatcgagtcattttgaaaattgctgtgaaatagtgacaaaggtctcttagatttcagtcccctctgcagcactgaaacacttgctagctactgccgctttaccagcaatagcccgtgctcatcttcctttgttttttttgattgtttgttttcttgctgtgtgttataaaacaaaagcaaaagtaaaagagcagtgcattatatcctggcatcaatacaatgaaaagcaaccatttttcaaagtttaatttctatgttacagataaggaagaaaaaattgttgttgtggatacatgaagtacggtcgtgttaatggcgaacgtattaatgaagagtgtgcctaaaatcatatttggatgaggaaaattctctacttgtgattttgaataactgtcgatcactcactcaccaactctgaataatctaacgtgctgttttcatgtaggactatagtcatgagttcttttttcttgtagctgcagtgaaacggtatttgtggaaagagattgctttcaatgccaaacccaacagttttgttttcaaattcctgaaaactgaaaaaagaaatcttggtgacatcaatgttccaaattcaaaatatccaaaagtagactcatggacttcctccttgaacccactgttccgtgtctgttctgtctggttaatgataatcaccgtccactcagacaaggcccagtcctttaaatcacgttcagctcagttttcttatctgtgagacagagcctttcctggaggtagatcttaagattctttacaactctgaaaacccgtacatctatagtatgtgattccttcttcacaatgcatcctacacgtgtgaaccccaccactcaaatctctctcaccaagtttccccccttctctctttttttaatcttgctgctactgtaacgcaactcattacttcttttttttttcatttttaaaagttttcttgaagtttagttggtttacaatattttggtcatttctgctgtacagcaaagtgattcaattatatccattctctttcagattcttttcctgcatagattatcacagaatattgggtagggttccctgtgctatacagcagttccctcttggccagtcattccatatgccaaccacagtgtacatatgccaaccccaacctccagtccatccctccccgaaccacctgccccctttggtaaccttaagtttgttttcaaagtctcaacttctcatgacttttgactatcctgaaatcactcagctggtctccctgtctttttttttaaattatttttaaattgacgtatggtaaaattcacattcatgtacactttggtgaacgttgacacatggagacacagccatcaccataatcaggatgcagaacagttccctcaccctccccccaaaatattctctcctgttgccacttgtagtcgaaccctcccccagacttagccccaggcaacctctgcctcttctccgtcccttttccaaaatgtcgtataaattggtcttcctctctttgagcacctgttcccagcccatgccttctctttgtcagtgccatttcttctggaaacatacctcttctctagaccttgagaaatcctttcttctgagtttccatttccttgttagtatgtgaatgggtgagagtataaaaatgattaccctgaagaattctaatactttctgccaaagctgactcttgaagaagaccccttgttttgctgacttgagtgactgaggtggagatcagaaaagcagtgagttgcttgagtaagaagtgatgccctggagctctcgaggtagaaaaaagagaggggccaatgggggtggtatcggcagggaagttgagggtgagcgtcgtcatggagggagccggatgtttcccagtgccctcaggacccctgtattagagatctccattccttcaggtcccacagcaccatggggtgctctttgaatggggctttgtattgagaagggcatcgggagactcagatctgcaatgggaacaataccgtctacactgccaggcaattgaaggtgtcataaaggagtgcaccggagctgagcatggcagagtctggatgctaaggaggacgtggaccctcttcttatcatcctgtggtgtctctagcctctcctttttcgtcctgccaaattgcccccaagcttaactctttagcttcgtcttcaggggcctcctgggctggccttgtggacaccaggtctcctgacagctcacctctcccttctctgcttcctgcccgctcccacccacctcgccccatctcatgctccaactgcgttcaagtccactttgatgaatcctctctccccttcgatccaaattaatctctcctttgtctgcggtctctctctgtttatataaagtacacaggtttcatatcataattattcatctttgactctctcctcccccttgagctgtataaaaggttttcaattcgtagttgataaaatgaaattaattcctaaattatcacagtaactttgagactagggaaaggaaggcaaggcattcacccatgtcatgctcccattttttatgtacaagtagcaggcctgcgaccgggcaggctgttcttttacagatttccttcagttgtgaatacatcaggcggtccattttcaaacagctgtttcatacggtcagagcgccttaggtgactcatttatgtgcataagattaggagacagtccaggtagacccagagagtaagggccaggcaggctgctgctgcagaaagtttggggacatggccctcttatggctgtgggaacctgataccacgcccccccatctccattcccatcagttcattgctgtgctgtcaagtttaagttccaaaggtaggcagggacattcttgctgagtaaggtgagtagatgaccttccagtatcttccaagtgcatcctgagatgcaggcacagactcctgctctccatgtgaactgctaccagtgcggctgactgtgaaacccaagctcaggatcctgttcctgggttagagccgaagcacatggctgacatatgttcaatctgcagcccacacaagcctctagaatgcttctcccatctaggacctcaccagcaattaccatcctgtgtttggatacgttctctttccagagattgggggcaggatgcagtctgcctctttctccctacccaggtcagccctgacgagagaaccctgcatccttggggagacatcaggggaatcacaagggcctcttcccctacccccagggctcggttccagaggtcagttggagagcaggcagcaaggacagagcgcccccctccccagcccatctccagggtgatggtctccagcagcaaacaaccctccttccttgccaggggagccgagtacacacgggtcttggatgagtgagaagttcccccaatgatctttatttttccattaagaaaatcaaatccctgttccagcttcctgaccttcagcagctccacatacgcccctggggtctctggggtggtaaagctacaggttagccagtcgtggtgggtcctgcaaggcaagagaggtgcggcaagaccctgctccttggggatgcgctgcagcctgctgccggaaacacctttctctttttttcccttcactcgctggagtgaagcctgataggagccagtcctgtctccttccaggattctcatagtctggagccagagctgttaagcctgaactgagctgggagtgggcgaggtggggggatagttttgaggaaaaacccacatctcccctcctcaagccagaatacactgcaaccaaaaatttaatcaagttgcccctgtgccgttttacaataagatgctcaaacaactgagaaagcagagttccctgctctgcaatgttatgaccttgaatcacggatttgaagctgcctcttttggattagaaatttcaaaatagtggactcatttaactttccctgttcagcgctgggagccctgccgtgtatgcattgcagaggctgtgtctggtctaggcatgtggtgggggggcagggccacctgagcgaagaccactcttattgtgtatgatccttgcaaagggtctgaacactttgggtacaactcaaaccctaggaatgtccacctctggggccccaaatcgggaagactgataggcacaacatttgggttctggctggagagccctgcaggactatttgtgaccccgaccttcccacccccgacccccacccccccacccaccctggtttggaggattcttggccttctccttggggaggaaactggctgattacggagaccctgctcttcctagcagcaccagcccctcagctcagccccgacctcactcatctcctaggattttagggaggtctgcacccagagggcactcccattggtccacacagcagcttatttttaaatggcctggggtgtcttgagcacatttttggttgctatagactaaatgtttgtttctccccctcaaattcatatgttgatccctaccccctagtgtgagatgttaggaggtggggccttggggaagtgatgcgttcttgaaggaggagccctcatgcgtagggttagtgctcttacaaaagagaccccacaaccccacagagctcccttgctcctttccacacgtgcagacacagaagacaactgtctctgcgccaagaaattggctctccccagatgctgaatttgctggctccttgatcttggacttcccagcctgcagaactgtgagaaataaagtcctcttgtttataaactgcccaatccatggtattctgtaatagcagcctggcagtccgagacacaagggttctcaaccttggctgcacattaaaatcacccagggaacatttaaaatgccaacatccggtgccacttctcagaccagtttcatcacaatgtgggatgggggtgagggtgagagaggggactggaagatgggacccaggaatctgtgcattttaatgcccctcagatgctcccgcaggcaaggctgaaccatcacattcaacagagcactcagtggacatccataccctttcggctgacctgctctagttagggcgacaagagctgggttctggttgcccaggaaagtaaggcttttctgtcattgcagtctgaagtcagattttccactggaataggaaacaaacgccaagtttattttaaacattctcttgatctacctaaaactaggaagtataaaggatcctgtgggagcagttcattctcacatttaaatgcgttcttgtttcctctgaatcaagccttatggttttatccattaccaaaggggccctgtgacttcctaggactatagttgaactgaaaattctggggccgtgcatagggtgactgggaaagtgattgaaacagtttttttttcaccagacagtgaacggtaatttggtccctgtaactggcactcttttctgtcctgtttctagatgggtcatgtgtgtctcataggcaaaggattgttcctggctgattatgtccagtgattgtttgtttaaaactttaaaagaagaagagcagatacactacattggcactcaattaaccacgaaaacatttttaggttaagaaaataaacaactgaattggtggtttgttttattaccaaactagtatagttgcaaaggcaggaaggagtctaggtctctgactggaaaaggttaataagtattctagtcaaggaagactgaaaactcaaaaagctttactattggttgaatttcactgaaattagaaagtgactcttttgatagccagcaactacagacttttgctggtgatgtggaatgtctttaattctgagagatgggcttttcagaactctgcacatggcatttgctttggcatttggcattttggggtgccatatttattgctttcaggtcctatggctgtagttttctgctctaattacccaaaaggcaagaaaaaaagtaacttgaatagaaaaaaagggaggggaaatatgttttgaaagtttcattaattgcaaaatgaagttaaatggagcgttcgatcaaagtacttctcagaaccgatggagggtttctcagaaagagcccattagagccggatcctctaaagcagtggaaatcccaggaacaaaagccaaatgcctaggaattgagttacagaagaatttctgaattggtgcagcttggtaatttacaaaatagaatggaatcactgactgttctaaaatctgttcagttaaaatgggataatacatttagcttacatgaaccatgcacgttcaactcttgctattatattttttaactgccatttattaagcatttttctgtgagctaggcctgtgttttgacattcttgatcttacttttgacgattacaaagattcagtgcctttcacagaagtcattattacattgtggaagggtcccaatgctgactccttggtgtttggagtaaataaaatctgcaatgttattctgtaaaatgacatctgaaattttatttatttatatatttatttacttatttatttattgtcttattagggccgcacctgcagcatatgggagttcccaggccaggagttaacttggagctacaggttctggcctatgccatagccacagcaacgcaggatcatagcttacagcaatgctggatccttaacctactgagcgaggccagggattgaacctccgtcctcatggatactagtcaggttcattactgccgagccataatgggaactcctgaaatatcatttagatgtatgtgaaagctaaccttgaaaataagatttccattctattgaagtgccttaaaaattggacctccattcaggaggaaaaaagaaaaaaagaaatcaggcccactttctcgcataaaccgtgggttaaactgggtgtttgggcagattattttgggccactctaggctattgcatgcaaatctagactcctggaagattggaagccgttctgataatcttccagggttaattctgatccttggcgcatgagagaaatagctgctggctgcatctcataggttggaattgcagtttaaagatgatcagaattgcagttaaacatcatcgaagggtgacctggagcttaactttcttaattaggcatttcgataacttgggataccaaccctaactgatatgagtgattaagtcaggtaatatcaatgcccttccactcaactataatctttaatttacctgatcagcattgagctcccttaggctaatgaagtctgcagtcaaagtacatacagactctttagtaaatctgattgcattaattactgctatggactgattttagttcttctttactgtaagaaattcctgttgctatttatgttgagtactagatggaattaaaaaaaaaatgaaactaccagcagccaaacatattactgtgaacccatgtggatatgttgtcttctctcccttgtgaatatattaaaattaacttctctggcttgggtatgtatcttgcaataacgactgctgccattttttttttcatttgcccaaacagaacctcctaacccattaaacactaacttccatcctcctctctcttccaatccccagtgaccacattctgtttttttgtttgtttgtttgtttgtttgtctcttatgaattgactcttctaggtcctgtttataaatggaattatatttgcgactggcttattttacttagcatgtcttcaaggttcatccaggttatacatgtgtcagaatttccttcccttttaaggctgaataatatcccattgtctatgtagcccacatttctgttgggtaccaatcaagtgctcgaattgaaaatgtagtgccaacagttttcctaaatgtatcagtttatgttcccaccagctgtgtatgggagttcatcatattttgcatactctccaaattcagaattgtctcttcattttagccaatccagtgtgttcgtaaaggtatcacagtttcggcttttttggttttgtttttgctttttgcatttctctaccagatactgattactaattgcttttcatatgtttctgtttttttattcattttaaaaattttattgaaatgtagttgatttacaatgtggtgataatttctgctgtacagcaaaatgattcagttttcacatgttccttgattctcctttgttgagttgcctgttcccgtctcttgccttgttgcctgtctttttcttgtggatttgtaggcattctttatatctcatgtactaaatctctcactactcatgtgggttacaaatatttttccccctctctgtgacttaccctttaaccctctaacagcatcttttgatgtaaagaagtccttaggttttttttttttttctttttcttttttttgaaagttcccagaccagggatcaccacggccacagcaacaccatatctgagccacacctttgacctataccacagcttatggcaactataaatccttaacccctgagcaaggctaggaatcgatcctgcatcctcagggatactagttgggttcttaacctgctgagctatcacaggaactccaagaagttcttagttttaatgtagccttactgatcactcttttcctttatcatgagtgcttattgtgtcctgctcaggaagatttttatctaacattaactcctaaaagttgtattgttttgccactcacatttacctttatatcgtgcacttgggattgagttatgtgagtgttttgaattgggagggcaaagttttcttttttcccacatggtgagctaatcaactcagccccatttactggggaaaatatttttttctaatgctctcctgtgtcagtgaacaatgaagtataaaattgagtgttgggagctcccattgtggcgcagcagaaatgaatctgattagtatccatgaggatgtgagttgaatcccaggcctctctcagtgggttaaagatcttgggttgccgtgagcttctgtgtaaatcaaagacaaggcttggatctggtgttgctgtggctgtggtggaggctggcagctgtagctccgattcgacccctagcctgggaacctccatatgctgcaggtgtggccctaaaaaaaagcaaaaacaaaaaaattgaatattgaacagtggtcaagtctataaaggaaaaaggagagtaaagagatggtgggagggcatggaggaaggttgcccttcaggtgtctgagagacacgccttctggggaggccgaggtgaagttctcgggcaggagcagagcacctttgcagcctggcagaagggctgagtgaggggagaggtgttgagaagtagccctggccagagccaaacgctgtttttcataatagatatttcacaacactccctttactctcctgcagtgaaatttgtggaaaacacaacctgtgtgcccacagaaactacaaaccatcaatagaatgccttaaccatactgtaaagtaacaaaagcagagtcaattataataagtatctcaacacatcagcatcagcgtaggcgtgaccacacagaagctccagatggtgtggtcacgtgttttgcacgcccttgtaggatcctgggaatgtggcagcaataaagacaggtggctgcagatgtgctacatcctgatataatgacagtcagtgtcaccattagcgatgtgatgtttctgatatggtgactacttcttagtcaagttctaaacaaaacaaagtacatcgttccctgttgcattcctagaagctgggttttcacagaaattatggagaaaacactttgtgttgacttgcaaaacggcagcattgggaacctccaatgggtgatggagagtctcaggggatgtggggcatttctgggctgtgtgggaccatcccaggaatttgaagttgtcccccctccgagctaggaccgcaattgtcgtgtggatcctggaatggtccccacagattcccctaccactcccaagggtgcttctgctcccactgggaaccacgatagggcccggcagatcctggcgaggatgatttaggggtttgttctgtgtggatgggaagcccgtggacagctttgagcatggaagtgaggtgatctgggtttcaaaggaatctcctggccacacacacagagaagtggagactgagatttcagagtctctcagcaagagcccacccccacccccctcagagctgcaggggtgtgggctgacctcagtctttcccctcctagagtctcctgcctgtcacccatcacagggcctagtgagcaccccagcagagctctgctgtccattgcagaggggcttccccgtgggggtccttttagccccaaaccctccataagtacaggtgttggctgtcacctcaagcagctttcagcagcagcatcctcccacacacatccataatctgtttttactccgcttcctacagtaaagatcagatgcatgcgaaggggttggaagtagctttgtagatgaacttcacacttgggttattttgccaggcaacctctccctcccagcctgaccccctccggtgcacatgtacccccttggctgggctgccatttgctccagggtttgctttaggcctgggagcgcagaagcatttcctgaaactggaatcccctgtgcccagcccaccagataatagatagataattgggtaagtcctaaactggaaactgcaaacaacaacagagaaaatgacatgtaatgcagggtgtgcacttttctccaagcggggccgtttgtgtgtgaaactacttaaaaccagtcctttatttctcaacaatggaactcgttcggtcatgaaacccagggcactctcaaagattgtggtagagaagtcagggctgtatagtataacgccggaatgaaagggcatgttccaaggtctcttccaccttgtggccctgatgggttttgtgttgtcgggaagaagggcagtaagggtaatgccccttggaacttgacatgtttgggtgcaggtggggcagggtgcccgcatgtgtgataatgaaatctaacattactgaatatggcctcagtaacttcatggtcttcaggacacccaaactttggccattgcaattattccctcattctctgatataaaaggatattggagtaaaagaaagaacgtgtagaccataatagctgaataaatacttccttgggagttctcatcatggcgcaacggttaacaaatctgactaggaaccatgaggttgcaggttcctcctcggtcaaggatccggtgttgccatgagctgtggtgtaggtcacagacgcagcttggatcccacgttgctgcggctctggcataggctggtggctacagctcattttggacccctagcctgggaacctccatatgccgtgggagcagccctagaaatgacaaaaagacaaaacaaacaaaaaaatgcttccttgatttggattggcatatgcacactgtggtatgtgaaatgactgtctgatggggactgctctctagcacagggaactgtacccaatattctgtgataatctgtatggggaaagatactgaaaaagaatggatgtgtatgtttgtataacttaattactttgttgtacagtggaaattatcacaacacggtaaatcaactatacgtcaataaaaatttaaaaaatgaaaaaagaaaaaaaacttccttgagacccccacacagactcatggaggcagaacctgtttctgtttttgagtatgggggtgaacaaatgtttgggttctagaatagcaggatatgctctttacagcctgggcatagctgggcttagaatttcctgtttagaaaaaatcaggcttgtatttagttttaccagttaggttgacaaataccttgtttcagccaagtgcctggaagtttcttctttgggggaaggtggggcttgtggcagaaatggctgtgggtccacacccagtgccgtcactcatatgtggcagattgaagaaagctttattgtttcaaaaataaaaggtgggaagaattcaggtatgggcctttgtggatacccactgtgagaaaagtattacttaaaatacctttacaaaaggtcaagtcctagggtagatgggcctgatcaatgtttatcaggaagtgtcagaaatcagtgtatgaaatcatagtcaggtagaagtgatctgaatttggctaaatcagagaacagaacagctcagctttccagctttcccaatcttgtgagaggtgggaaatatgaatcagaacctcaaaaatggggactgagagagtagacatgcacatatcttcctagggagttcctgttgtggctcagctgtaaggaacccgactagtatccatgaggactcgggttggatccccagcccgactcagtgggttaaggatccggtgttgccatgagccatgatatgggtcacagagtggctcagatctggtgttgctgtagctgtggtgcagctatttaaataaacaaacaaataaaaacaacaaaaaccttcctagatctcttcttgaaaaagaaaaaaaagtccagtttccataagtgggtttgtcctcctcacaactatatatgttttccttctttttggagccatatcattgtcatcatccccgctcatccgtttatcttcttctgactattcatttgatctgagatgtttgtaaaaccaaggaacagaaagcatcttgatcaggaaggtctgaagaagatctcttcttcctctgctgccattgctgtgtggtccaaaaaacgtgtagatagagccttagaagagatgaatgaggtgaaaggcttggggtggagagtgggtcagagtgagggggtggccacagcctttgatcgaaaaccatggacagttagagctggaaggaaccttagagtccccttgctcaatctctcatttcatagataagaaaaataaggtctcaagagttaaagagtctgccaggggttgagccagctaatgggcggtggaaccagcaatctaagggccgatttttgatgaagaactttcgcaagttcttcacataggctcacataactgatgctgagagaggagaaaggatgtgaagaatttttttttctttttctttttgcataggctgttttaattctttatcaatgtcagtttattttggtttgcctttgaccttcactgccccagctgggcagcataaattgtggctgttaatttgctctccttgacaagtttgtgaaggactttcttttcaaggaggtagcagggtcgagaagggaaagttttttctgtacattgcctacctccactctgtgatccggtccagaatggccttggccattcttaggctgacaggatgcaaaacgtgggccctggtgtgcagatgttcgcctgatgtgtctccgtgtgcattactggattggttttgcaggaaaatctaagacaaagcattctgacactggtattagccttgctcttcctgcatctaattgatatgctttacattttgtctcgcagaattgccacttagaaagaattctcctttcatagaaagtggacttgattttttttttaaacatatagcattatggaaatgttgctgcattaccaaaccctcctaaaaggctgggaagcttatttttatttgatccctgtctttcctgtgatttgagactaggttgtaaacaagccataatgcaaagggactaccaagagacatacaacagaagcaggctcagaaatagaaattgaatttataggcagtgagataggataattagtttttatatttaaaaatatcctcaaaccagaggagtctgttgtctcagatggagaaaggaattgagtttgaatcccagtgcttcacataatagcttagttttctttgtataaaatatacacataaagctgtgtatgtgtgtttatatatgtacatcctttgtatagtcctctcaaacacatgtattaaagtgttggtttaaatccccaaattcagattgcacagtcgtttatgcttataattcctagccttaaatgttgttcatatagctgattagcccaccgtctatggtttttttgctttgagtagctgtttggagttccaagatcaaacaaaaccctttcctgcttttttgcatggagagcaggaactgtatctggtgtttactcaacattttatgtttttcatccagctgtttttcactacagagtgttcatttaataccctgtatgtaggtaaaacagtacaagacaggagagtgtgaagtatctgctgatgttaaatatgtataaattcaacctaccatctcaaatgatggtgtcttagccactggcctcgtcgtcctgaagtggcagaaaccagatcctggctttgaaccttaaacagactttgtttttcagggttgcatcacgactttgggagggcatcttgtctgaaatgtgctgtctccccagcctgggtcaatggggacagagagaaatagcatctgtcagtggggcggaagtctcccaagtgtggagtcaggcactggttctttgctgagggttcagctgatgcaactgccactactgtggcatccttgtttccacagaaaaaagtctaagaatgggatgaacttgtaaacaagaagaaaccatgccttcctccttacttgatctgccttgagcaaagaagaaggcagaagcgcaaaccccttggtacctgctctgtgcatcataagagggtttcatccaccctgagatctttgtctctttctctgcctgctgtcataaatctcagtttcaaaggaaagaaaagagatggttgttaaagcataaacctctaggtcagctctcgttacatcaaactccaagatgatgttccaaaccttttgttgaactgaaatgctagaatggtttgaaataaaactgagccatccgttgcctggggataggaaatctttctgttgtaaaaaggtggctgcctgcttggtgtgtgggtgtgtttgcctatgtagaaagtgggatggactttgcagtagcatttatttgccttgtggagactgaacacagaaagcaaagaaatccagtgcacctaaaaattagagaaattgggtagggaagctcagccatcgttttagagcagttttcattcaggtacaatttcttttgcttgcttgaagttttcagtgtcagatcaaattttctgtcttgcaccccaatacctcatatgcttggttgccatctgttcatttccattgcaaactgctctgtacacaatgttactcagtgttaattagaacatgtgtctctttgtcattcatctggggaaggggttaatgatgatttatgtccttttgattcattttcctcaaaactattatatttcagttatgattttataaggactccaagagaatagaaagaggaagaacacctcatttctattcttcatggccttatttttaaaaactcaaccttggcctaaatgttttagtattgaaaatatagtccttcaagatcttattaagtagtaacacataggagtgtgcatttactgcttaccagtgaacaatgtattattgtttacatttgttaaattattttaaataggtcacatattcacatggttcaaaattcaaaaagcccccaaagggactagcagatgcaaactattataacagaatggataacaacaaggtcctattgtatagcacagggaacaatattcaataccttataataaactgcaatggaaaagaatatgaaaaagaatatatatgtgtatatgtgtgtatatattagtgtgtgtgtgtataaaactgaatcactttactatacaacagaaactcacacaacattgtacatcaagtatacttcaataaaaataaagagccaaaacccaaaaggtcccagaaggtttgcaggggagggacttattcttcccttaactcctctgcccaggcacctggttgactttcccagaatccgtgtgttatcagggtcttgtatgtacatatagttatacttatgtatacacatatgcatccatatatataggtatacatatgtatatacttatttcccccttttttaaacagaggacagcaaacatacatgcatatgggcttttctcttaaatgcattttggaattcagtgtacattaataagttaagagccagcgtcctctttctttgttacagctacattgtattaatgtactctggcttattcaccagtcccttactcatagccatttaatgctgtttccagtttttttttctgggacagataatgatgcaatgaatagctttgtattaaattattttgtgtgtctttagaaagaaatcctagaaatggaattgctgcaacccaaagtgagtgtgtttggcatttcgattgattctgtcaaattgccttccataggagttagcggtttacagctccgcaagctgtctgcataattgtcagccttttttacatttgtgaaaataataggtgaaatagctatctcaacttacagtttaatttgtcctgtcctttcttttattttgagtgatgtttggtatagtgaacaatttaaagtaaaagataaacacgtgtgtgtgcttggtgtgtgtgggtgtgtgtgggtgtgtgtgtgtaaatttcaaagatggaagcctatctgtgcatcccctaaaaacaccaataaactatatctggtttttagtatattagacagctaatttctgtattgctgcatgattaacagcaataaacgctggaagatacctaatattctcccttacatgattaccaaagcatactgctgaaatcaggtttcagctgaaattatctttaagaatgatgcattttggactaatctaatcaggctttgatttgtgagggtacattacctgatatctttcaagatagaaatgttaagtccattaaactgtggcatgttgctttttactaaaagtgtatggattttagggaaaccacactttgacagacatgatggggaaacaaaagttcttttagataagaacggccaccttctccttgatatttttctctgggttgagctctacgtgaaaagctggtgtggctctttgtcctgactgttgctttgctgtaaagactgaatccatcaggaggaccccatcctatcagagagaaaagccggggattctgttattaggtgaggtctttatgtcaggttaggtgttctcacaagtcacatagatctttacaagtgggaaaacacatcgtccatttcttggtagactgaactttccatcttacactttaaaaaggcaaaggctgtaatttgcatagctaaaaagattgagtaaccaaccccgccttgggaatgccattttctttcccctaggagtccctagctgtggtttcttcaggaaaagaggtggcttctttggcaagtaggacatttgagaagtgagcagcacttgctcctttctgatagttggggtttccctttgggacaaacatacttgcccttgcagtcgacttgatgaatgatgaagttggaatagctctctttttcctcctttcagtcaggaaataaactaatctccccaaacaaagctgccttgaatgtttaacagcagttttaaatcgttgaaatagtcacgagtcacgagaccaatttcaatcctcccccgaatctagattcacaaaattttagagccagaaggtgatttgcagatggtctagcaactgatcccaattttgtacatgaagaaatcgaagctgagagaggttttggatcattggagtgagtgagtgaataacaaagttagaaactcttgtatcctggccccagaatcctgactaaattgttccagaaattttgcttaaatgtgattttatttttcgtagaaaaacatatgctctttcagaaatcaattcaaattctcttggtgaaactctttggtggttggttttgctacagtccctcagcaggagaagatcatggaatgccctttaaaagagacacctagactgtgcagctgtcgagacagataagtggaaaaataaggtctttagggatgctcccccatcacgtggtgatgagtctacaggacaggggcaactttctagtatcttctgctgtgtgcaaagagagaaaccatagcagggcagggatgttggaaaaaatagaggcatcacggctgattagctgggactggtcagaaatgggttgcttcatgggaagcagttaagacaaactttgtgaggacttttattcttttggggggagggatgagggtggaaagaggaagcgagaaaaagacagagggttttaagaacagagagagggaaggagagaagaagagaggggcagaaggaggagcatgggtcttacctgaatcacaggtagtgtattgtctcagaaatctcctgcttggaccagaggaactgttgccatttggcggcagctgccttaaatatagtccagagtttttaaatattacagacttgtctagcacctccagaggccgtatttccagcccaagtgcatcatctgaggtttagatgcctatagctaactatgggttacctaggagatatctgagcctcagcagaccgggacctgacctaccctcttaatccgcacctcaaccaggtcttctttctgaactccttatctcagtgagttacatctcagtcctccaagggagccaagtcaaagctttgagaatcaccttgatttatttggttccatcttttgcaccctctccttggctggctccacaagcccggttgatcccgcctcctttgtgtctcccgaatccttcctctcctacttccccactaccgccgttctagctcacaacctcatcacttcttcttgggttgttgccacagtctttaagtggcctccctgccacccagtttgtgcctctctccaacttgtcttccagaccgctgccagagaactctttctaggaaagcctgtccaatcatggaattcccctgcctgaaaaatgctgctgttgctgcctctcccctgcagagaaactgtccagaccagtccatgctcacttccttagcctgtcttctctcgattcccctcctcacaggagcctccttacagcagtgtgctttcctaccccgctgacctttgcacgtgctgtttctgctgaacagcaccttctgcttccccctgcttccctcttcctggtctaattccttcggatctttctgatctcagcttaggtggcacttatttaagaaacacacgtgtgtacatttgctgggtgccgagcactggtctaagggctttatgcgtattcatttactccttagaaccacaagaggaaagaagggttattatccccattttatggatgaggaaactgagactttgtgaaagagcttttcttactggcccactggctgcaaggattgggccagaagccagcttttgctgctcgttggcacttgattttgatatatatggggtatatacttatacatatatgcatgtgcatgtgtatataacttgcttttgaataggcataggtacatattattaagttccaaggatacaaagtacgcagtgacaaggaagtctccctcctacccttgtcttctaaccacttacttcccttctccctgcaagcctaatgttaccaacctcttgtgtgtctttccagggagtgcacacacatacacatgtacatactatataattgtgttttgacatttgcgatagcatatcctccttgccatttttactttgctttgtttgcttagcactattccttggggcttgtcccatatcaacacattaagagcttcctctcttctctgatggctaaataataggccattataaggagatgccataattgattaatcggtctccttttgttggatagttaggtagttctcggactttggctggtacagacattgctacaaagactggcttgctataggcatcattttgcatgcatatgagtttgtgcaggataaaatcctggaattggaattttgggtcagagggtaaagacatttataattttgatagatagtgccagattgctttcctaacggatgtatccatttagtctctcattagtaatttatgagagtgcttctctcctcatagcctcacccgtgcctgtagaataaaatgttttgatgtccaccaatcctaatacattgtttagtctgcatttctcttttttcctttttaaaatttttaattttttcaattcagtttttattttgtattggagtagagttgttttgcaatgttgtgctagtttcaggtgtgcagctgagtgattcagttatacacatacccattctttttcagattcttttaccatattggttattacagaatatacatatttttaattatactgctgcacccactgcatgtggaagttcccgggccagggactgaatccgagccacagctgtgacctccacaatagatcctctaacccactgcgccatgctggggctctaacccacatttctgcagtgacctgagctgctgcagtcaggttcttaacccactgcaccacagcaggaactccctaggttattatagaatattgagtagggttctctgtgctataaagtaggtccttgttgattatctattttatatacagcagtgtgtatatgttaatcccaaactcctaatttatccttcccacctttccccctgtgtaactgtaaatttgttttttaaatctatgagtctgtttctgttttataaataagttcattgctatttttttaatattccactgcatttctcttataggaataaagttgagtgacttttaatgtgtttgcgaactattttggttttcttctatatcaactgactgtccattggttttgttggatgttttcttattgatttataggcattccttttatattaaggaaattagcctttgtctatgatttacgttcccaatggttctctgctttgttgtttgtcttttgtctttgtttatggtgtatttttcccaggcagaaaatttttattttcatgtaatcagatttaccaagtttttttttttttttcttttatagcctctggggtttgagtcatagtgaggctggcctgccccacgcctagattctaaaattctcttccatgtgcacatatgtgtgcataaagttgtttcagagagagaatcagtagagtataaaagtttggaaacagattctggagtcacactgacctgacttttagccctggtttcatctttaactagttctgtaatcttgggtgacatctttagatgggttattaatatctacatcctagggttactgtgatgataaaatgcaacaacacaggaaagtgtcttgcgtctgattactgatggctgcctttattgtgccattatttctctccagattccagaatagctgcacaaggacagaagccctttcttctctttcccttgcattcctcatgtcattctgcccggcccctccccagtcccgcttctaacctgagtccaggaatctgctggaagcgcctgagtgctcattttgattgcttcactgtttattttgattgagaggggaaggcctggaattctggctagagccacctggagtaccacaggtgcttctccacagcgtccctgctcaccacacatctgttctcctggccctggtgtcttgccagatcttgaagctttggttctttccccctgttgtcagtgagagtctgcgttcttcctttgttttcttttctttttaggccataaccacagcatacggaaattcccaggctatgggttgaattggagccacagctgctggcctacaccacagctcacagcaatgccagatccttaacccactgagtgaggccagggatcgaaccctaaacctcatggttcctagtcctgttcgtaatctgctgagtgacaacagaaactccccaccttcttcctttgaagtgccttgcagccctgccctgtaggtcccttgctgctgtgctttccctccatggatcgtcttccctggtcttgtacccaggcacctcccctccctttgctgggtctctgcgggtgggtgcctttcctgttcaggttcatgtgcagagaggacaagatgcagtgccgccacaagctgggtgcccagaaaagcctgggacccagtggctggggaagagtaagaagcttgggatggaggtattgattgcaagacccgaaaatcacttggctctgtctccattccttacaggccttgccctgaaggatagatcccaaggccaatcccaactagtgagttttttagtggatgatcaccctaaaaatttccatcacgtcagtatctgttaatattttctaaaacttcagctagttgtcatcgatgctaactcctagatgctaacgccttaaaaaaggtgtaagatgatgcaagctgttcaaagacatcagtgctttggaggcagcgctgagaattagaccttaatttcctgactttcatctcttttgttctctttaaagcctcctttgcctctttaaggatttcttttgtatgcttggttttgacagcccagaggtaggagatgcagtgaagtagttaagttcatctcataggtgattttgccactatcctcaccattaataaaataatgcttggagcacaggcattgagttttatagtgggctgtatcaaatgttaattgtcacgcatctgaagcatgctggtacactgccaggcagagggttcaagggaaaagtgcaatgggggatagataccaagctaagtcacagccaccagactcaaaggcagcacctactgtgtgtggagcccttcacttctcattttacatttgagacttgcaacaatacccaaagacggccgtctttattccaattttataggtaaagaaatcgagttgaagagaagttgatgttgactgtatcatggttgcagatttaggattaagatggtggacctgatttcaaaacccggggtcttttggcctcactgcatttccttccaagagcagacagtccagtaaagaggaaagaggaataaacagtcatgcgactattttcagtgaaaagtaaaaataatgacctaaaaagaagagaaactgattgatccccctgagttctctttctggctggccacgttggctgtaaattccatagtgcagctcgtatggtgaacattcaagagagaaaggtcactcatccgcagtcctgctccccagcccccaccttgataaaagaagtctccttaccacctgactctcctgcaggtaacaaaacaggttttcaaaatatgtaataaagaagccctgcttgttccttcctggcagtcatcccagtggaagtacaatcacacaggcactgcctgggaccctgggctggaggagttaattttttaaaaaatgcttgaggttcctgagttcccatggtatgttactagaaggttctgtagcttgaaaactctcagcgctcatttcccccaacccctcgccatgccacacatttaaggacaggttggctcatcatcaatggatgctcctcaatgcttacattcactgtgctttttcttggaaggatttcagctcttctgtgacatagttcagttatctcctctcttgcttccagaagcagcttctttacctcaactggaaaacttgctgtagtcctgagtgttttggaaacaaaatgtgcagtgggagaattcctgctttgtgaatatccgatcactttgttccctggcacaacagtctctcctttgtattaaacgcctgagaacagaagttctaaataacatttttatactccctgttgatagaagttctgtattcagggacaacagtttgatgcttgttcctctgtcaagttctgatgtcctttccctgcttaagtaacaagggtgctccctcccaagcctggaattgcacttgtggggaggagagggtgcctccccgaggactttctcattggggctcttctgtgtccagtgagtggcctgggccctagtgggatggctggctgctcagagcaaaggcaccgaatctgctggtctgaccatgagcctagtggctgagccagccagatacaaaaggaccagatgggctgacagaccaaaatagccactccatctccttcctggaaatgcagaagggctaccccggaagtccaagaaggcctaatttggtcaaaaacccggcacttactcagaccaggaggttgggttgtgaccctggcatgagttcctgacccccagtgtttcgttgttaccagccccatttgcacatcctcaggttgacagccctgatcagacagacacccagacaactgattggtaacaaatactcttaacactaaagcacctctgatcacttccctttattttgtacttgtacagagtacttgtacttttactttaaacaaaagatgtatatgcacgctcatctttagacaaacccagtagtataaaaattcattttggagttccctggtggctcagtggggtaaggatccagccttgtcactacagtggcttgggttactgctgtggctcagattccatccctcgcctggaaacttccgcatgctgtgggtgagccaaaaaataaaataaataaaaattcagctttgtaagatgaagtaggacacttttatttgttttctcagaaaatttatcactgcgttccaaatggcatagatagaataataaaatatggtctactcccaaagaatgtttgtatttccgtgtaagtttcaaagctctccctttttcttatttatttgacaaatacacatttaattatcctactggaggcaagactgccctacatggccatcctgtagctcatacagggagctcattggctctcgtattttattactttgggtcaaagataagtttcttgcccctcattccttcagtgaatatttttctcctgtttcctgtgggccaagcactgtgctgaatttttcggtgtttcccgtgttccctttgggagtggttggaacggtagtgctgttttcgcccttggaggaagggggccatgcctaggctcacccactccccggcagctgggccttggtacagcgaggagggctcctggaagctgatacacacacagaggccccctgagccttaagcacagggatagattgtattattttctaagagaaaggacattctactcctcctcgttaaccttcccttgcaggctaaaacaggcaaatcactccctggacagaccagctcaagtgataataaaaaatatcctttaccaggcagcctggcagtacctgcattagtgtttggataagaacaagcccctcgagggggaatggagcccttctccagaccttaattgatttttgtgttcattctgcttcttttaattcttagtggaaaagtgatttgtagtgcaaagtggctttccatgttataggcactggattatgtaatcccgctcttatcaaaagatcatttctgcttgctttgcctttttttttgcccccgatccagctcatgtttatttttcttttttgctttatttcttcttgtttacacagttattgttcctcttactgctcccacttatcaatccccatcattgggggaggcaataggattcccttgatctattttttttttaattttaaaagtcagtttgttggacatctttaaggaatagtcacttattccctagcaagtttgtttcataatgtggagcgtcattaattataagtctgactcccaagaagctgggttatgttcattcccagggattaaggaacatcctggagtgtttgtccctttgggatctgggccatcatctgcccctcctgaccaaggtgagcctggctcatgaatgggatggctccttacagaggtaccctgtcatgtaagaaagtcccatagaagagtaactactaaaatctctttcctaaagtgaggttgtgaagccctcaatcatgtgcctcttaaacagttgatctaagaaatccacaacttaaccgtcaagtctgttggcatctttgagttacattgggagggaactctgcctgtgtcctcatgtgatacatcaccttgtgcatgcttgcacatatgtacacctgtgcgtgtgtatgtgtggattgagaaaaaggagatagcccactgctaggggttgaagggaaagactttgttaggtttacatcatgactaaaaagacaatttgtttattgcagtcttcatgtgatcaagaacaaagcagatgagaagaagcccaacatgatcaaagcacatctaatatctcaggtttctagaacatctgagtctcagggtttggtcttcattatggtatatgctgagaggtgatgttttaaaaacaagaaggggaaaaatgccagctgtgaagaactgagacagtgaaaaagcagacgtgtgcacctgaacggagccccttctaaatggagccatgctctcttcagtctgcagggccagagggaggattctatgaaaggtcataaaaatctagccatatagttccttctgttcagtgtagattctcacatgcagtggccttaagcattgtgacttgatttctcgtgggcacaattcacacctgtcttgggaagtccgtttggggtgatcttgccacctgcaacttggaagagacagcacttgctgagtctggacgtctgatagctggaagggcaggacaggtgaccccctgggtggctgggaggtgttaccttgaaactgaatgctgggataaaaataaaacagtttctcccggggacagggcactgatgggagtcaggatccctgtcctgataaaacgctgcccctttgttctgctccttgtgtgttcttccacatgaggcctggcagacggtccatttagtgttcattatggtgtcagagccagcacatggcagggtgctccccagctgccacgggagccgtgcacacatggacgtgagcagaggcctttggtgcacacgcatggagcttgtcttctgccttgtttccctcccagggtgagctgggaacccagcccccatcctgcaccttctggcacaggggctagtggccctgcatgaggttctacagtcatcaataggcctgttcacgtgagaggtgacttcacatttttgccacaacatcacaggctgctgggctgaatgtgaccattcttcttagagcaagctgagggcaagggacctcttccgtccatccatctgtccatccgggaaagtcatcactcccatcacagatccaagggacttgatccaggcccccccgagggagcactcagcatttcttttcgtgggttaaataaaactggatgagcaaatgattgtgattaagctctattgtgaggttttctgatacccatgtagcctaatcactgaaatctttgtcaggccttgttttgcatgttaatccatgaaggaagccagtgacagcctctctgaggttctctgttttcattgtagtttattcttaatcatccaagtcaatagggaaaattaccgtcatcgatgatacaaacccacagaaagtccagaaatactcgagatggggacagcaggcgtgtgagccagcacacatgctctctcggacattcagcagctgtgcgtccctgaggacagacagggacagtgtccaggcagggtccactgcaggggtgggggcgaggccagggggtcaggcggaggaggtggtggtcagtctcagagtatggcatcagatgtggagaactgaccacatttccctctgatgccatcctgtggattttttttttttttttttttttttttctattttggctgcagccggggccggggccagggatcagatgtgagccatagttgtgacctaagccactgctgcggcaatgccagatcctcaacccactgtgctaggctggggatcaaacctgcgtcccagcactcccaagttgccactgatcccgtttcaccagaccaggaactccttttgtggatattttatttgtactttttaaagatcaaagtaacccacctgtgtggtcaaaaagccaaatagaacaaaaggcatttaatgtaaaataatgctcctctcctccctcagacccactttctagaggcaataccttttaaccctccctcaatttataaaagttattttcctggtgaccttcatctctttaaataatataggtttacctgttgggctaaggtcttaaggctgctgtagccaagtatctcaaacagggtggctacaagcaacaggaatttattctcctgcagttctggagactagaagtccaaaatcaaggtgttggcagggctatactccctccagggagaactttccttgtcccttccagctttgggctgtggctgcctatccttggttggcagctgtatggctctagtctctgcggctctggtcaactgcattctccctgaatgtttgtctttaagtggtgtttcccacttttttataaagacacctgtcattggcttagacgccactccagtgacctcttctttgatctgcaaagaccccatttgcaaaaaagtcacattggcagataccaccgttaggaatggaacgtatctttcggggacccaattcaactcctaacaacactctttctcagtttgtaaacatttggttttattgacttcgttccccggtagatggcatttctcttcccaattcagcccgtttctcccgagcctcttccctctgtgggcacatcaaccttcccagttccttaccttaaaggatgtggcttacatttcgaacacattctgaaacttcatttcatttttccattaaccatagagagcatgacttaattacccactaaaaaaagtgacaacattagctcttctgactgccctcccttctcccaccttccagcctctgtctactagtgccaagtttgggaacacctgggttctttccgggtaactagtggttaaatcctttgccatctgtccgcagatgcagaattgatgtctgtctgtagcttctacagagaggatctacaggtggaaaatcagtaaacagtgttttcatctttattattatgcccatacctgctgtattatgttgtctttgtgtgccctctgggttttaattaaaatgctttctgctttttgaagaatgacaatataaatgtatgttttatagtactttcgaatccacatttcatttgattaggttttagttgtcagtatactttcctagcttagttgggaaactccatttattagtacagcttgaaatccttttgcattaagtgttgaaatgaaactttgtgtcttgtgaggaaatgcttgatgaaataaaacaatacccactcttcatgggtctctactcttcaagagtttctaacagcaggtaagtcattcttaggcagagctagccacacttttgtatttcaaaacttttatttttattttatttttaaaatttaaggaccaaaatagaggtgctaacttctcattttgccaagagatctggtatttactctcgctggtaaaatatagaacatttaacacccaaaagaggaaagacatggtcttagaataaattgcactattttaaaatggaatgatatcacttatatgtggagtctaaattatggcacaaatgatctatcgacaaaacagaaaagatcatggacatataggacaaacttgtgtttgccaggggggagggggaaggagagggatggattgggaatctgaggttagtagatgaaaactcttgcatttggagtggatgggcaatgagagcctggtgtacagcacagggaactatatatctaatcactagtgatggaacatgatggaggataatgtgagaaaaagaatgtgtatatatatatatatacacacacatatatatatatgacaggatcacttcgttgtacaagagaaattgacagaacattgtaaatcaatcataatgaagatttttaaaaagaaaatggaatgaatttaacttaaaaaaaaatcactacgttccccattttttccccatttcgtgtagactagtagaactggactggatggagggtttcctagatcaaccttgattcatggtcgtgtatttggttttaatggatgtttgaatataactgttaatttctccacttattcttggctggttagtttggtttactagaacccaatatagcagatactcaagaacaggggcaggagttcccattgtggttaaagacccgacgttgtctctgtgaggatgtgggtttaattcttggcctcgatctgtgggttaaggatctggcgttgtggcaaaggtcatagatgcgactcagatctggtgttgctgtgctgtaggctggcacctgcagctccaagtcgacccctagcctgggaacttccatatgctgcaggtatagccataaaaagagagaaagagggggaaaaaaaagaacagactccatatggggtgagaagcttgctcatcctattttgggaacccaagctatagcttgacccccaacatccatgtgtactccagtccaggccacctgggctagttcataaatgtgggttggacatgagagcaacaggtgaaagggatctccatccgcacatgcagatctggcacttgtagccctcgagtaagtcaccctttaattctgtcttaatttctttttccataaagtggtcacaaaacagtatctgcccatatatgttctcccattttgtaactgaggtttgtaactggcaaactcaagtattcaatggttgcacgatgacagcatttctatagtattcttaaacgaagctaaatctaaagcagaatgaaatcactgactatatttgtcccattaaataaatctgattaattaaccatctggttcagttttttctctccttgaagcacttgtagtttgcaatatccctgttgtgaggttttagtatgttcccctgccacgggcaattgaatttagtttttcagaaatttaatgtttttaatatgacattttgtgaaatcctcccaaacacgaacaaaattaattccttggtggtggtgttgctgttgtttgtaagaaacgttggtgtgtgtgcctgtgactgacctcagacggttgtgatgctggtactatttagcacgtggtgctgtgctaggaccgtgtggttgagagcattgattaggtgatcttcacaacatccctgagaagtagcttgacgttgtcttcccacgattttcacacaggggaagtccatggtagaccaaggttaagaagcgagtggcccaagtttactcagcaagttggttgcaaagtgagaaaaggaagtccagtgtcttgaaaccacatcacctatcctgactggcaagtggcatctctctgggttcatattcctgattttcaggattcacaccaggccattttggtcgttgaagaactgaacaatggacagtgggatgaatcaagcatggctttcctgttggaagcacagagttgtgtccctggaggtttcggtgctctgagaagtggagggagagatggctgtcatgctcctgagtgcagtacagcccccatccagggggaaggggccctcaacctgtagcacccccaagcttggtctgtttactagagtaatggtctagatcaagtggtccacactgccattccgtttcattggtgaccagctgacattacagaaaagatctggttctaattcatggaggtggacaaagtgacaggtgctgaccttatactgctctaactctgtagcacttggctctgttgcacctcagctgtgccatcaataaaatgggaaatgatatttagtgcctgaaagcagaggatcagggcagaccttcccattgtatgtactttgattgttccaaatgcccccaagaggaatcagacttgcaaccaaatgctcttctggtcgaagcactcctcagccagggttcccagcctgaggactagatccaggtataggcagggcaagcctcagtagcttcacatcctgctcctctctgtttcatttctgcctgaattccacatgaacctcagaagacctcattcctcactgtctgtttgtccccatcccatggtttttgctgaaatgcaaggcatgtgctactgtcatgctgtcaggacggtgtcttatggtgatccacctggagatagggccttcattggagttggtgtcaaattctaggtgtgggagttcctatcatggctcagtgggttaataacacaacacaatgtccatgaggatgtgggttcaatccctagccttgttcagtgggttaaggattcagcattgccacaagctgccttataggtaacagatgcagctcggatctggcattgctatggctgtggtgtaggccagtagctgcagttccaatttgacccctggcccaggaacttccatacgcctcaggggcagccctaaaaaaaatttctaagtgtaaagagcaaggacaactcgaaggtttgaaccacctcatagtgcatctttcaagaacctgtatttggaatatgtgtattaacttgtaatacaaacatttggaagtttcaaataacactggcccactaaaaaaaatactggtattgattaccctgatctcagtgatgaggcgtactcatcaaagaaaaatgggattcagtgcaagcccattttagtttttgtctagtcatgttgtacgtgggaattgttataaagcagaaaagccaccaggcattactttatctcccaagcaaacattctaaatagtggggagcttgctgtacataaaaggaagctttctctcatgccaaagctggccgaacaaactttgaatcctgaaagtaaaacccaaagacagaataacttagacaagcttttaatgggtggaaaataaacattaactttatatgtatttcaagaatgtaaaagacacaggtaggaaatgaatcctcctcgataagaaagaaatgcttagtagggtggaaaaaaaaaaaaaagaaaacattcagtagtttttgatttttggaactgtgcaagtccagactgtttctttctttccttttttttttttctggttagctgctcatagccacaaatatgtatattatttccttcttgcccacaattatactaagaatcatttttctaatataccggggaatcccaaataaaaatctcattttcctaaaaaacagacaagtctttgacggtagtaattaaattattcaatcgtccacagctagaatgtcaaagatataatcacattgttataatagtagaagcctctgatgcccacctcaaatagttttctccccaaatttctactgtaatcggctgatgttcttagggaaggtttgcctcggtcactgatgtttgaaaacagcacttagaaaccttcttctctccagtgattaggctgacccagttatgcaatgtaagcaatagaatcacaggatattttaaccctttttttgaatatatatttttatgtgggatgcaattattaactacttcgaatacacttcttgtggaggtgatcagaataggaaacccagctgactccatagtgggtcagtaaagtgtcatgtcttagcagcatggatgggagagagcctgcgtggattcaagactcagctctgcccttttcgacccagttcttgatgcttctttttcctcatctgcaaagcgccagttataataacaacacctccctcataagtgtggttgtgagttaatatgagtcaagagcttagaacagtgcctggcatgccctacaccctgtgtcagtgacagctattgttattttcacaatgagggaaacaaggaactgtgtttctccccgggggtaattctatttgccattaaaatatgtttttgtttacagagttggtgagtgttgtctgagcattctcatttaaaaaaaaaaaaaaggtctgaaactacttattttgccttttctgcttccttcttaatttctgcctcttgcctgttttcttctaggtctagatctgatagatttctctaggcagaacttctctatgcagaacctatgcagaactgacctgattgaacttacctggatatggaaggaagtaaactacattttattggtgcttttccacgaaagcatgaggacataggcagaaagtgaataaataaagggcatttgcaatggtaatgaagcaagtgataaagtaggtgttttcaattcgcttgaaagtaaagtttctgtccattaaactgactcgaatgaatgatcaagatttaacaagttctggagttcccgttgcggctcagtggttaacgaatccgactaggaaccatgaggtgtcaggttcgacccctggccttgctaagtgggttaaggatccggcgttgccgtgagctgtggtggctaggattccatgttgctgtggctctggtgtgggccagcagctacagctctgattagacccctagcctgggaacctccatatgcctcaggtgtggccctggaaaagacaaaaagattaaaaaaaaagagagagagagatttaacaagttctgtttccttgtaaatttttgctttttatatctaataatcttaccgaatgaagatcctgtggatgtctttgtttgagatgtagagaaaattagcattatttatatttaaacaatgaaatcttggtagagacacacattcacccttgtcattcatttttgtctttgtttttaattttcaagtggtaaacctaaagagttcactacctaacactgactaaaaaaatttaccttgacattcaagtataaaataccctccttagtcattctttttcttaaggttacacagtcatggttgacttttatgtactaaaattttaaaatttccccttgcatcaataatgtaaatccatgatatccataagctgagttgcacattaattattataaaaagcaatataaatcccccaggccagcattttatttaatttgattattcatggatttgtgactattatttgttgttggtttattgttgttgccaattttaatactcggacttatagaccatatgttgtttcagaaacttccccaaaggcagtaaattccactaataagtggggaaatcacttatctgtgttcagaatacctcaaaaatgcaaatacagaagtttgtgaattttacatttgtattactgagaggtgaatatgaaaaaaatacactcatcatttatcgattgaataggtctaaaaatcttctttcctcattcgaactataggagttttgaagagtatatgttttgatataaaatgaaaatatgctaccaccaccatcctcattatagtattcattggacttgtatccatcagagatttcatggaacataaccagtgatcggcactgagtgacagaagcctgtaacttctgatgttaagcggtcatgcaaaactttgcaaatatattatttgggatattcaataataggagaattcagttctcattacttaacttgccttaattttcattaaaaattttcatttcattaatagcaaagtaaaaaaatcacattcacaagtgataagagtattttgatggaaaacagagctccctgtgtgttcttccctgcagcagggactaatttcagatatgcaaattcctggttgaatatgtaattccacatgcttttcttgagggcctcttcgaggagggagtataatacgctagcaggagtatgtgttttggagtcaaactgttcttggctcaaatcctgacacagtttcttgcttactgtgtggccttgagctgccttgtctttcaaatacctgacccaggagttgttgaaactcagacagaagatgtttaagagttaagtgggaggctggggatgcaagtgtatgatgttcagcgagtgctttagtgctttcctgcctccctttccttctctcccgtgggaaccccctgctgtaagccccatctgccgtgtgggtgggggacagagcataggtgcctgaaactacccttgcctttagggaacctgatcgtattgtattgtaacatctttagctggtcccttcgctgtggaggacgtggttaacagctctgttacattcgggggttgacctttatgatcatttcgaagagcacttccagatctgaccttctttgagttgatgatatcatgaagcaataggttaaagaataggagacaaacaatagggtgttcaatagtgtgcagtgtcgaccacaataatgtattgtgaaggaagagacaattgaagcgaatggcagattagatgtgattagacacggatcagaaagtgctctaaagacaagttccctagtatgtcctctacaaaacactccctcctcaagatggtaacaggtaggaattgagaaacaatttctgaaagtcacatgggaaatgctgactgacacaggtttctttccagtaggacttttcagagtctttcagatgcacaagtgtcttttgattccgaaatgagggtgtgtggtcattgtctgaagcatttccaaaatgtatttcatcatagaatcagaattattttgcacccgggtaatatcttgctggacgaatgcttcatggaaggtattttgcaaatcatttctctatggttttaaaccaggaatgtaggacatgggtaccattgattcaagccaccaaatctactgagtgttgaccacttgcaaggccctgtggaggccagagatgagtaagacccagtctcagtggccagtctggtgaccaggcttcgagtgaggtgttggtggcaaggctaagggcgggaatggcctggggagacgtctcccagggggttactgatgcagaatcaggtgaagcagcgtcctaaggatgaggagtcctgctttctgccttgtcttcctctctcaagttcttatactggtatttttttaacctgttcacctcagagaaattctgaagagaaaatgaacgtttggtgttccacgtcaggtggttggagttaaaccagttggaaggttcatttagaagatttttaaaaattgactctgagctttagttttggggagagtcatctctcagtatgtgagggggattggttccaggaccttccatggaaccaaaatgtgaggataaaacggcatagcatttgtctataacttaccacatcctcttgaatacttaaaatcctctctaaattatttataatacctaatacagtgttaacactgtgtaaacagttgtaagtacactgtaaataatgggtaaatagttaccagcctatgtcaaattcgtgttttgctttttggaactttttggaattttctttttctgaatattttccatctgctgttggtggaatcacagatgtggaacccgtggacacagaggccacaggtgcctggttgtttcaccatcccattgacgtacagctctaatgtcaaaatctaacccaaggagaggaagcctggaaaaacaaacaacacacaaggcaaccagctcctttacaagagacgtggtatttcattcaatgttggttgaacccaatggcgtaatctacagtttcctttcttaggattaaatatgaactagggcctcatggcggattttcctgggacgaacctttcctctcacccgacagatctgtgggctatttcaccactggcttgtgctgcctcttaggccttaggaaacgttttggcaggttgtgccgttattttgctcatgttgtgagtagcatttctcttgaccttttgttatttactgaaacagtccagcctgttttcttttaagagaagcgtgaaatgaaggggagtcggctgactttggtatcagaagacggacttcaggctgcttggcttcaaggagacttttcaagtgagggggtcactagcctccttgtttcttattcacagaattataaggggtcttttcaggggagttttttttttttttcctcactaaaacagatacatgtaaggttactcatttctttaaaacatttcccacatctaaaaacataactctgtaagagtttttttctgacatcttgggcatggtgggttgtccagggtctctctggttttgaacgtgctgggacgagtttcaggggaagacagctctgactggtgacgggcagcccaggtccaggggatcctgactgacctctcatgactcgtgtctcatgtgtttctcagcgtctcacaggggttctttctcccttctttctgcctacctgggtgtgccacacctgtctcactggtgcttttgtgcctctgcccctgataggggactccccattcactgcaggtaaaggaagtaccaagatcccatcacatctttgaagatgagaaaaaaatgtgcgtgtgtatttcaaagcatatgccctaccaccgagctacatccctagccctgcttgtgtatttatttatttatttttccattcttggccgaccctgcggcatatggagttcccaggacagggatcagatccgagccacagctgtgacctaagccacagctgtggcaacaccagatccttaacccactgttttaggccagggattgaacctgtgtcccagcacccccaagacatggccgatcccattgcaccacagcagaaactcctgcatatgtatttacatacactcttgttcctggatccccatatatttacctactactggtctctgcctcagacagaaaattctacaggaaattacgtcttttcgttgggcttcccatagctcttgaactcagctgctcgcgttaaagacatcactcacatttttgtcatttttgttctcttagccaaacaagatgaccttgacatacataaatcagccccagtgatttctgtctcattctgtatgacctgtgggtttgagaattgccacagtctcatcatgggccgttgctttggagatgtttcattcatctcttcagtcattcagtcaacagattgtcctcagtgttgggttgcactgatggacagagccacgggcttctcatggaactcataagtgaatacagaggcctagatgatatgcaagtaaaccagaaagtaaggagttggtagacagcagaagaagaatgccagataaatggggaggggtgaatttgtatagatcagagtgtccctggagatgttgttgggccccagacctgtcagataaggaggagtcctggaagtcctggggggacctttggagatagaaggcagagcaaaatcttggcctaagttccactcccctctcctccctccctgtgccttatctcatgtctatgtttggcacttgaggctatgacctgattgctctttaaacctctgtgtcattgggaacactcacaaaacaatagaaagatgctgtcttattagattcctgctgagtccagcatgaacctttcagaaacttggttatctccccccagcccccacccccgccccgactcttctattcaaagaggctacactgtacagatcagaagatacggtgacttcatttcttagagaaaagtcgtaggaaatcctttaaaatcctctgatcagaaaaagaagcagcctagaagttcaaatacgaggctgagttggatgagctactcactgactaatactaactttctcatggcactttttaaacttattattttgcagtaactatagatgcaagatgttacaataatagtacagagaagtaccttgtacccttcaccttgcttcccccaatgggaacaccttgcatatgatagcatatagtataatataagtatagtataaacattagcaacaccagggaattgccattggtataatctctagacccgagctctgaatagatttcgccagtttctacctgtacttgtttgtgtgtgtgcatgtactttatcccatgtttgtgttcctgtaaccaccattgccatcaggatacagaactattccaccacctccaagaaactcccttgtctcctggcactcatgtatcagaaatcgcagcagatgatattctgcttcttgtctgggtcatattctgggtggatctgtagtgagagaggttagctaaatctctgaattcaatcacttgatttggctgccatggaatctgcataactgacttacaaatggaggcccttggtctgacttgtaggaagaacatctataagcccagaacaaaaccccacaggtttgaataaataacctcaacctcatcaagggagcctgtcagttgagaccacttggtttaagaggctgtgactagtcatgtgacctcagtagtttacttcaaagaataaaaccctttctgatgccacatcacttttgggactttatcagtatgggaatcctattccggtatttcttgaagatggccggggaagcaaattcatgagtaatgggtacacaggttacctcatccttggatgcattccttataaaaagagaagaaattataggaagatgcccctttgtggcatggaggggagaaacctttaggacgtgcagtgagcgagagctttaggtgcaggctgaaagagaaacagctataaacagattgagggagagacaacggatttaagggaaaacatctgcctgcatctgacatccaaaagctgcatctgtggccgaggatcaatcttgtagtgcttaaaaaaggaatgcgagggggcccaaagcgggctcggcaagtttcttctttttcctcgagattttctgtttgctttgcccagaatgctgccaggctctgatgaaataaactcatgtggtcctgtttcttgatgcaggagaaccattcgttgtaagctaactttagaatgactgaaggaaaagacatttcacctgtattgttctagatatactcatcagaggagcccatttactttgctaaatgaaacttctagaaatctccagatgtatttcaagtagacattttcagtattaaaaagctggaaaccagaagaaaggagcagatatgttctttttttaaaaaaatattagagtatatttggtttacaatgttgtgccagtttctgctgtacagcaaagtgacccactctcatatatatacacacacacattccctttcttgtagttcccttgctgtacagtaggacctcatgagcagacaggttctcatggagcctcagaagagattcagagcatctctgtcaatgctagattgaacttaaaatttgtcaaataagtccttggcttaggtattcttttttctcttgagtcacttgtttgtatcctgtaggcacagaacaagaggctggttgaaaggaaatagagatcaagtgttccccacagataggctagttctccatttctctgagtggaagcaaaagaggatcatgggtaagggcttcaactctgcctcctcacctagtctgcccagtgggatgctttacattccaagatcatcccctcagagaacgtcacggatgcaatccatgctacccaaagaccgccatccctgagatggagggagttgtcctccattattgtccacaacctttggggatgtttcacagttaaagtacttcctaactttacccttccctctcattgtccacgtgtgttctgtctttttaactcttatctttatttttatacatcttgctcccaaccaagattgcaatgagattcctgtgtgccattgccacatacattttgagcaatttggaattgcatcaaataggaattaagtgtgtgtgatgctgttcactagagctctgttctgaataatgatgacaatggcctctgcatttggcagcgttggggaggggggaacgttgagtgagcgtggctgataatgagggagggtggcatcagagtgtcgcaaaatagcagtaagagatggtcacctgctctttgtgctcagaatccctttctgatgcatagactctcagcatttgttgaaataaattgagccagatatagtatgtcccctgtttccagatttctcctctatcatgtggatgtcctaagccctgtgttctcctctatcatgtggatgtcctaagccctgtgttgaaaattaggacaagttacaataacatcagctaattcacctcaaatcacataggttgaacgtggtttgaactcagctttgaacctggtccaagtgttgaggagacttttggtgtaagggacagactcaaatttcattttttctttcttatgagaaatctctagaactgtttcatgacaaccgggcgaggactggtgcaatctgaagatctccatcgtagagtagcctaactcaaaacttgttagctggggtactcatttcatgctgtttgctgggcatttcttccgacattgaaaagcactggttgaatttttccagacaaagcagttgaccttaggatttggcatcctttgagtttacaccataattcaaatccaaatcctttttaaaaaaagaaaactgtattacacacaaaaggtggcctgatagtgaggcaaagagtaataacaggcggggcagtctcaaatcaggccagggtgacaggctgggacatcttgttttcatcaagctctcatagctacctcttacttctctgtgtttgctgggcttttgagattctgttgtgttctctgtagctggatgttttccagagggtcatcaagagaaaggagtatcctctgcattaataacctttggaaggattttagcagtaaaatcagaggctgaatgatctggtagagaatagaaatagggcggcgtttatttccccttccaggaaagtgtcaagttcaccataccccagcaccagaccctcttcacccaatacctctgagaactcgtataaagtttactcaataatagtgaagtaaatggcaaatccactaccctcgttttgggaataagaattgttccttttaaaggcatacgagatacaaagtaagtgactgcaacctcttacttggggtaacagctaatttcttcatgttatgtgcttttctgtttctttgtttttttgggggggtttgtttgttttttggtgaattcattaatgtggagttacagaataactcttgaatatttacacttgctacctttatctacttattgaaaagaacagatactatataaaaatttaaaggatatactgagttgggagttcccttgtggtgcagctggttaaggatacggtgttgtcactgcagcagctttggtttctgctgtggcaagggttccagccctggcctgggaacttcagcatgtcacaggtatggccaaaaaaaaaaaaagtatactgaaatgtatgtcaaagataaacaccatagatgaggagtcagaaaactatggcctatgggccaaatctagcttgccacttgtttttgtaaataaaattttattggaacacagccgtacatctttgcttatagattgtctgtggctattttccttttataacagtagttaaaattaaaatcaagaatggatgtcttaaaatattcgctctcagatcctttactgaaagttttccaatccctgccacagacacctccatgatatccattcattcattcattcatttgtccagttgatattcatttgttcggtgaacaccaactctgttaaagatactaggacacgcagagatgaagaaagcagtttctaatgtccaagaactttccatgtgacagagacaattcacaaactcagatgccacctcctgcagcacataccatagacctagagagaactaaatttttgtgtagttcagagatggcagaggccctggacaaagggaaggaattgggataagcaaaaggatattgctttcatgagtatggctcccagtgatttcccagtgggaacttcatgaaaataagagtcatttccttcatggaactttataaattgcagtgcccaaaaggtggaaatgatttaggatattactgagcatccagatttctttatctggaagcatatttcccctttaacttgggggatagtcatatttctagaaaatttgtaaaggtttgaaggaaggcttcctttttcaggtgggaagacagaaggaattcctttgcttttttactgactgctccctgaggagagtaatagtaaatggtctgggtctacagaaaggatcttagcaggaaacccctcaaatatcagttgaattaaaaataaggtaaaagtacagacctcaagccatgaataagcatgactcagtgagtctcagaatgccacagtgtgccagtatgaagagaactcttggtgaaggttctcgtcaaatgccacctcacctggaagattccatgcaggaagccttctggaatcttccagttaggattaatgtctgtctcttcatttgcgacctgctcaagggctgagttcatgccctttttgatttttgtatcagcaacagtgcccactccacagtttctattttccaaatacctagtgatttaacatgagctgaatgccaactgacacaccgtgtcttcaaaatctaggtggccaattttgttgaaagaccctagaattgaaggtttatctaaaaatgaagcaagtgagaatctgtccattctgctgccatcagaggatcaaaaatgttggctgaattctggtcacctgtgctctgtattcatagcaacaaagtgactggagcaagtgcagctgattttttttattattactcaatgaattttattacatttatagttgtacaatgatcatcacaaccaaattttatagcatttccatcccaaaccccagcgcatccccccaccccccaacctgtctcatttggaaaccataagtttttcaaagtctgtgagtcagtatctgttcaagtgcagctaatttatgttagaacacagccctgcgaggtttcccccactaaaagcatactctttcaactgataaagtgagtgtgtttgttgagaaagctactgaaagcaaatgatactgaattccaactagtacactttatcctaggaagcatcaaactgaaatatttcccatttcctccctgagtaggagggcccctgaagttgccccccaacacccagaccctagcagcatccccctggggctccagccccaggttgccaagatgccccaactagccctcagtgtctcctaaagtttcctcagtgctctgccttcacgggagctgggtgccacttcacaggggtaggcctcaggtaaagactagaagagggacatgtgttctggaagctcatcttgcgccccacccccaccccaagcccaaagaggaaaaatccatcccttgcgtgtgaagagcaagctttagggcatttgctgacaaacagataaagtcgctgcctacactgctgggtgccgttttccgtcacaactggccaagtaaacaccgactctgctgtctccttcaggccccaccgtatatttatgaatgggatcgtttcctcattttcttttcctgtcagtagcagggaagtcagaaggcattacctccaaaatggggaaagaacactgcaagtccacacatttgcagccatctgtggcagagccccgatgtcatgggccccgtcccttcggggtttgtcctgagtttctgatttatacctttttaccctctggagggcctagaaatgctgaagtgagatgaaatgactgattagcctcaagttctgttttcactggagtctttctggacggcctctgattccttcccctttcaagccctcggtggcatgaatccactgggtttctgcccacatcactgcattcctaggatgcctttcacaggcctttgcaagatcatctgacagccgcctgtgaggtcaatgaactttatacataattaaaccttcgcagtgaggagaattaatttttttcccctccctgagaagcagagaaacaggacatgttatgctgccctccattactgaggaaaagttctgtggagtcatcaggctcgtttcacatgatttaatgctgaaccgaataagaaagtggttgcatcctctactgggcctcacagaacagtcaccacccacactgtttattcagacttgaatcttggccatttggggtttaagccagaagaaaggggggggggggaatccaaccctggaatgaacgcttttgaaactctgtattcttgatgaaatgcggccaaggattctttaaaaaatctatttaaaatcaattactgggatcgtattttcatttacaatggattgttagcaacagcatattttctctgtttccatccagctttggagtcagggctggaactggaatcctccctctgtttgcctgggtatctgatgccaccacccaactatgtgggtaattgggcaactctgacctttgaccagctttccataaaataacaaggaaaggtgtgaggaggcaaggaatcaaatgaaaacaagcctaagggattgcagaaagagtgctcccctgccccggggggaggggagggacaggaaaataagaggcatctctcatattagaggaaagagaaagtaaagggcaggactgggtatgcctgggaagagaggccccaggaccatctgccagggttgcaaaaaaaaaaaaaaggaaaagaaagaaaaaagaaaatctcagatatgtcagattgtctcgggtttttaaagctctctagaggagattctggaacgtccggccgctacccaccctactcttggcggttcctacagccagggcattcttatttccagcctaaactgtgcacgtggagctgcttcaggggctaagttattgatggggaccgccccacctccccaggcacgtgttactccgaagctgggagggagcctgtgagttgctgattggttgaagctactgtcactttgccctccatacccagcagcccccagggcgactggtggaattggtgctgggcacaggatggagactttaagagtctggcactgttacctggcattttgtgtacgtcatcaggaggaaaggacatcgctgtgacatgtccacatatccaggaatgagcttcacaaccatgtgcaactattaagtatgaacctccgcttttggattttaagcgatccaagtttttaaggaacaactcttgaaaaccagaagggagatagactcttgaatttcactgacctcgagatggtaggtagttctgctcctcagttttctaaataagagctcagactctacgggtagctgctgtgtctccagttctatccctggaccaggaactcgcgcattatgtgggcagggccaaaaaaaattagagctgaaagccagagagcttaagggaccaatcctggactagacatcaggtctcatgccccctccctgcccccagtgtcctgcccttcagaggatggtggtctggaggcgaagtgatgctgggactgaggtcactttctcacttcctctggccccttccgcctccccggcagatgcgcagggaatggtcagcgcctctgtgagggagttacagattcattgaaaagctgtcagatacccccgggcggcctggctccttcccttttttttttttttttttttttttttaaataaatcaagttatgtcattgccctacctcaggctgcactttgttccagaagggaagtggtcgtcttccctttcatccgcccacccccatctgcaccgagttgcagttccctgtgcatataaattactgaatgagtggagtgagcagtgcaatttgatggtgagggtctcgagccctcaaagactaagcccggtgtccactcctcactcaccttccctgtctgtctagtgataataatacttgtgctaactgcctgaagggcccctaggaataaatgataatatctatagatatctttaaaatatgcaaaactcagggttctgatattgtgaaatatttcaagcaaacaggaaatgtagagaataagatagcaaatgcctttgtatctaccatcgctgtcatatctttatgcactattggcttcagatcttcttacctcactttaaaatgagagagaaagagagaaagagcgtgcacttcctcagtcccattcctcttttctgttctctgagcttcacagcttccatttaaatttggtctctattattactaagcatgattgcatgttttacacatgtgtttttccatagacagtatgtatatttttcactgttttcagtctttctctatacaatatcattggctttggtgagattcatctcttgtaaaacatggacctctgcttcatccatcccccattctgtgtggtagtctatcaaaggaaggtcgttacagttgtttctaaattttaaaatgtccatttgaagaatatgatagaggtttctaacttcgtgatattacagatggtgctacaacacatgcatgttctttgcctacatgtgggagagttgagtttttcttagagatagagataggtaggtagagagacagacagacatctacatatgcaacatgcccaggagctaagtgataaagttagaacatcttcaacttccctggatgtcgccaaattgctctccaaagtgatggcatcaattcaccaccattgtggtttgagaattcctactgccccatattctctccagtatgtgtcattgtcttatttaaatttttcttttgcccatctgatggctgtgtagggtttagatgtgatttcctgatttctagtgaggttgagcatcttttcatctgcttactgaagtcagctttctcccttaatgaattctttctttttatcctttgcctgtttttcttttggggtgtttgtttccttaatgatttattggagtatatgaaatgttcttgataccaatcactggactcttatgtgcttggcatatatcttctgttggttttgtaattttattttattgatggtatgctaagagtttttcattttgttttagtcttataacaagtttgtggggtaaatactatttctattcctattttatcagttaagatagtgcctctaagagagtttaagtaaatagactgaaatctcacaactggtggggggggggggctggatcaaatccaaatctgtctagttctagcgtgctctttaagacataagcactgtgaatgtcctcattttacagatgagcacactgaggctcagagatgttcagtgatttgctcagcatcacacagtgcagtaattagttctgtgaaccagaactaatcttcaggtctctagatggctagcacaattgtatacctggatagaaagatgggggaaaggaggaaaaaaaatactgcatccacatatccttttaaaatgtagctttataaaatgacaaactatttgaaatacaaacaaaaaaaaaaaattcacagaataacacagcaaccagtagtcaactctgctcagatttaataaatgttgacatttagctaaatttttaaaagtttattttatgctgaaaatcttacagttaaagcctcttttctaccctaacctgatcccattcccctccaactttaatggaggtagccactgttgtgtatcctatcaaagttgtatcgttacacacatattgttgcatttatctcctggctgtgtgtcatgaacaataactagtattttttgtgagtttaaaacatttatggtcatgtctttaataatccatctttctgcaacttgctttatcactcaaaattatgtttttaggatttatctagttaattgatgcagagccagtttccttacctgctacctcaattccttttatgaatatatcataatatatctattctctaattgacaggagttcatttatacacagtgctgttgtgaacttcctttggcttatttctccatgtggatgtgtgagcttctcaaaggtgggggtgcagacatggatttctgggttttaggggacagacatcatccactttggtagatggtactgaattgctctcaattcacactttcagcaaccatgtatcagaattcttgttgctctgtatcttttccaactgggcatcatcaggctttcacattttgctaatatgacagattgaaaggtatcttatattgtggtattgatttatatttttctgatttctggtgacatgcttttctttctcatgattgttggtcatttgggttattttttggtgtatttccagtttatagattttgctcattttttgtggagggttatttggtttttttctttacagattactagatgtttactatgtatcttatatacttaaaaaaaacaaaaaccaaaaaacctctctccatttcttgcccttagcctttgtattttggtgtcttttgtcacataagttttaaaatcaaatggatcaacatgtctttttgcctttttttttttttttgctttatgggtttgtgctattgtgtcattccctaatgtggggttataaaaaatcgtctatatttttttcttaaatattttaaagttaccagtaattcttttggaattcatttttggacgtaatgtgagttgaagatttgttgttgttgtttttttccatatgaataaccagttgttccagaaccatttaataaatagttcagtcatttcccacagttttttttttttttttttttttttagctatttcttgggccgctcccgcggcatatggaggttcccaggctaggagtcgaatcggagctgcagccaccggcctacgccagagccacagcaacgcgggatccgagctgcgtctgcaacctacaccacagctcacggcaacgccggatcgttaacccactgagcaagggcagggacctaacccgcaacctcatggttcctagtcggattcattccactgtgccacgacgggaactccttcccacagttttataatgctactctgtcacatccccagttcctacatgcagaggggctctctctcttatgttggtctacttatctatatctacaccaatcctattgtgtcttaactataagccttttttttttttttttttcttgtctttttaaggctgcatctgcggcatatggtagttcccaggctagggttcaaatcggagctgtagctgacggcctaccccacagccacagcaacgcaggatctgagccacatctgcgatctataccgaagctcacaggcaacgccagatccttaatccactgagcaaggccagggatcgaacccacgtcctcatggactgggtttcctttcctatttttcagattgggtttgttactgctgagccaggactcaaaaactccttggctgtttttttgaccttaattcttctgtatgaatttttaaaccagctaaaaatgtccatgaaaaacctttctgagactttaatacgaattatattcaatttatgtagggaaggaactaatgttggtgttgagtcttctcatctctgagcatgatatattgctctatttaggtcttatgactttcagtgaagttttataattttctttcatttaacttttgcacctctttctttagatttatctccaggtttgtcatactttattgctattgcttacaggatcttttaaaagttacatttttaattggttgttgctgataaggatgccatggatatttgcatattaatcttgtttccagtattctttccaaactcttttgtaacttgtaattgtagtttctcatggattctctatgtagacaatcttatgtgtaaataattcttttgcttctccatttcaaattcttatttctcttactcctttttcttgttctattgtatcagccaaatatgtcacatgacagtgaatggagtcgtggtagaaaaagcacatttatctatgtcctgattttaaaggaagtatattcctaaagtttattttaggttcttaatagaaactacttagtaaaaaccttcttctatgcttggttgtctaggtattttattgtatttttaaattttgaataggtgttaaattttataaatgttttttcttcatctattgtgatgatcagttttttcttcttaatatgtcagtgtggcaaattatagcaagactttctaatgttaaatcttccttgagcttcttgaataaatcttattggatcatcacatacacacacccatgcatactatatactaccatgtgataaatatatgtgattatgatatatgtgatacattatagatatcatataaaacatttattttaaaataaatgtatatttatagacatactacacttctaggtatgattgctaagattttattatttgtgatcataatattctattttttggcgtatcaatttttttgtcttttttgtctttttagggccacaccgcagcatatggaagttcccaagctaggagtcgaatggagctgtggctactggcctatgccgcagcgacagcaatgtgggatctgaggcacatctgtgacctacaccacaggtcatggcaacgccggatccttaacccactgagcaaggacattagtcgggttcgctaactactgagccatgatgggaactccccggtgttttaactttggtaacatacttttctaggaaattttccatttaatctatttttagttttattgctttaaagtagagaatagaattatcatactctaaaacaatctttactgtatttatagttatggctccttttcatatctaaaagtgtttatttgcgccttcttttgtttctcttgctcattcttgttgagcacctacctactttgtctttttatcttaagaaaatccacatttgttcctatgtatattgcttctttgcttttattttactgatttgttattatctttatcatcaccttcctgctactttatctttgtccatttgtggaaaaagaatttttttctattgtctttgagtttattttattgcttaatttttttgttcttcctaatttaaaatgtttcttgttttcttatattgcatttaaggctaaaactccatctactaatatctagggttttagttattgttcagttccaaatagtttgttactttcatttttattttatttaataatttgacagtgtgtttttgaaatttcaagatgttctggggtttggggcctgtggttttgttactggtttcaacttttattgtatttttggttgatgagtgtggtctgaatgttagcaattctttgaaatttgttgaaacttgctctgtggcctagaacctggtcaatttttataaacatttcatgtgtattccttatttattgaatgaagggttctcttcacagccaccagataaagtttgtaatatgtgttatttaaattttttcctattttttatactggtctgttgatttcatagaggtatgtgctaaaatctctaactataatcttgaatttgttaccttcatataattaaatcagtttttgctgtatatatatttgacctgtgtggttaggtatatggaagaattgctggtgaatgtatctttgaatctttaaacagtgatcttctttatcactctagatgcttttggctgtaaagtatattttatcagattaagtcattcaattaaaataagtatttattgagcatttactatttgtagggacacttattatcagaaacattttttcctatttactcttcctctaacattatattttaggcttctctcttaaaacagccggcattttacaaaattcaatctgaagatttttttccttttaatgaattagtttaagccgtttacatttattaagtcatgtatttggaattcactaggaatccaaatgttttctgctgccatgcttcttgtatacttattttttttcttcctgtcctgccttctgttagattacttgaatttccttgttgattttgcatcctcttccctgtgcccagtccttggtcctcatgtggcagtagacccccagccatggccatgctcagggcccaagcacagatggctatgtttcaagaaaacctctgcaaagatagaacctgctcaggagctatttcctgaagaagatttatggatgcactttggaaagaaacagctctcaagaagccagcctgagttatctgaaggccccattggacattctggagcctatccagtccagaagaaacaggaaacatgcaagaaacagcaggataaggaggatatggatgaaaagacaaaaaggaaagatgaaagcaaaggtcctccgggtggcccagtggatgtcaaggagtggactggagtcctcctatagtgcctgaagctgagcagtcaccatggtcaccacctggttgcagctgcacatacctcaggctgaagatgggaaaagtattgaagaagatctttgaacagatgaacaaccttcacaccaagctagaaggcttccatagtgaagcagagcaccaggaccctaccagtggttgtggggacccactaagctgtgttgtatgatgtcattcggaagaatttcaagaagctcaagtagccaggggataatcaaatggaatgatgtattgagaccctcctctcattctgtgatgggttgagcagagacatccttgcctcttaacaggggctccagactctctcccatctttttcctgttgaggtttctccttcatcttgcctcccaagcacaaaaatgtagtcatactgttaaaacaatgattactattttcctcttgatttgtaatgtatacagtttgttctgtatctcagctgttacccttaaatcttaaaaattatatttgagttcacaaactctaaaattaaagcatcgtctgtatctctatttgcttcccaaacaatgtaatatagattccttagaaaattttaacccagcttttctctctctctattctaatatgacaccatcagctgttttattttcatctatcatttgtttctagttgtttcgtccatgtaaaattgtttttacaaacctactttttaaaatttttgaggcatctaaagagatgccattttggagttcctgtcatggctcagtgattaacaaatccaactaggaaccatgaggttgtgggttcgatccctgcccttgctcagtgggttaaggatccggcattgccgtgagctgtggtgtaggtcacaggcatggctcagatctggcgttgctgtggctctggagtaggccagtagctacagctctgattagacccctagcctgggaacctccacatgctgtgggtgcggccctagaaaagacaaaaaaaaaaaaaagagagagagagatgccattttattggtaagagtatgaaatccagaatgagactgccttgatttgaaggcagtttaattgtaaattacttagaatggtgcctggcatgcagtcaagtacatagtaagcccttgatacatattattgatattgtttctcaaagtttgtccccccctttctcaggtcaaattccttcatactgaagtacatccttaagtagttctttcgtcaaggatttagggagttgaaactatctcactctatctgaaaatatctttaattcagctttagtcttgaataataattttctaggtatagaattctacatagatattttccctcagcatttgaaaatattgattcattgccttccaagatctttattgatgaggttcagtcagtgacaatctgtttttgtttagaggtttgggttttttttttttttcttcttctgattgccttaaagatttttgtttgtttttctttttgttcctgtctttgatgatctgcagtttcaccacagtcctttttgggattctcttgaatctaagaattcctagtattcattaattctgaaaaattctgtcataatcccagaatattgtctcccacagttttgtctattttttccgtcttctgttgtttgttattagatcttatttttctctttttcaagtctcttaacctgtatttcctacatctttatttttctgtggtctatttttttcttaatttcctcctaccatttctattcttgttcttctaaggtgagcaaggtgaacatctagtaggcatccttccatatgtttttccaagctggtataaaagtaagcacatttttttatagattaaataacagagttttggaattctcttgtggtgctgtaggttggggatccaacattgtcagtgaagcagcttgggttgctgctgtggcatgggtttgatccctggcccaggaacttacagtttttttgaggacagacaaagaaagaaagagagaaagaaagaacagtgttttgttgtttgcaaaacattcaatcataccttgtgcattactttataacctgactttctctcttaatagtacattaaggatctcttccagataagtagataaaatttaattaaaaaaaatagctaaccaaatcctgtgatatggcagtactacaatttattcagcctttccactattggtgaacctttaggttattttcagttttatgtttgtacaaacattgaaaacatcctcctacatatgtacttacgtgctggttccttaatttctgtgggaacaaattctacctcacctgcttcgcctgcccccccctcgccacacttccccaagaacatcactttctctattttagctctttcttctgtcatttctaaatgatgtggtatgctgtgatcttttgctttatcaactttactcatgaggtcttaacttctgattatataaatgcaaatttagctctcttacatatccactgctttcccaacccctttctcttaacataattatattgcaatattaggttttatcagttgttagtgtttttgctctttggcccatgaaaatagcattaacagtcaaattttttgtttttatgaagttaatatctgtcttgctttttccatttccttagtgttcttcatccttgtggggaaagatgttccctctattatttttttaactgacttatttgggttttttcttttcaataaatttttattatatttatagttatacaaccatcatcacaacctaattttagaacatttccatcccaaacccccagtccacccttccctctccccccacctattatttttcctagtctcacagtacagttttccacaaggctgatcactcagaaatttgtgaggaggttctcttgtggcacagtggcttaaggatataacattgtcactgcaatggctcaggttgctgctgtggtatgaattccatccctggcctgggaactttcacatgctgtgggcatggtcaaaaaaaagagaggaaaagaaatctcttagttctccttttcttggcaacattcttcctggagacttccattttccttttatctggaattttcttcaggcctgttgcacagttgtcatgctggacttgctcttccttgttattctagaactttccttggcctttccttggcctttccttccttgttattctagaactttcccctctcttgatttactccactgttttagagagcaaactctctgacacgctttcagaattaaagccccgtgcgctggtggaggcctcactctgactctctcctgattcactgatccaggcagttcccttctccacctaaaccctctgctttcatcctgttaggtcacatcaagttccactcaccctttttttttttttttttgtggctcccaatctgcaagcagcttttcaaaagtggatgcaagaaagagagattcatactttgaatgtctaggaggttttttgtttcatcttctcactggaaggcttatctgtcttgcacaaggaattctagggcaaaactaaattttcttcagtgtgaagacattgctgtagtgtatgctacctcccagtgttgctgttagaaagctaaagccatactgatttttgatgctttgtacctgacctttttaaaacatttctccttggaccttgtagaatcttttcttttccccagtattctaaatttcacaattttcctagtccgttttcatctgttgtactgattaatcagtgtgttctttcaatctgtcaaattcacttctctccgttaactcatctttctttccagaactgtgggtgttgtactttctaggctagtcctctaatttcttcttctattttccatccctttatcttttgctctctttgggggcagtttctttaacttcaatttccaacctgtctattgggttttcatttctgttattgttttaaatttcctcttttcatctataaatagtctttttttttttttaagcattctgttctgttttcatgtgacagtctcttagctttctggaaaaaaaattatcttgaaattttcttctcccttcatggcttctatttcctcagtgttgcctttttgtgtttgtctgttttgaactcttttgtttcaggtagaggctttccttgcatatctggtaatccttgactggtcatatttaagaatgaggaactaataagttcattggaagagctaatacgtttattagaagaactcataggtttattggacatttactgtgggctctgaagatgtgtggggcttgttgactttgagcatttccatagaataatggcttaaggccatttgttgggaactcctgaagtctatgaagaacctaagtgttcagggaacactcttccaaagtctcctctggagggtgaagctctgcctgccccagtgcagagagctaaagtgaggagtcaggctggaggggtcagcatttgatgtgcatattttctgttttgttggatgtgtggcagctcccagtccaggaaccctgtctccagagttcagctttaccagttgggacagaggctgccacccagcgaggtggacctaaggaggggatctgggggcagagggagataactggttcttaaaaaactttcgtctcatctcatttcagtcactctgccctgccccagttccagaggtgactagtgctgtctgttcctggacctttgcagtctctgctggttggttcctaacttttctgactcctggtttaggattctgacctctttgttgtgctagttctgttaccactgctccatctgttttccatcttcacaaatcttattgctgctaccccttcacctgttctcctagtcctggtgggtttatgtcttttaaatggtcacctggcctcatcatagtgaggtttcagggtgaccaatattagatacggtgtgttcaattttccattgttacttggaagtcctatgttatattttggttgatttcctaaaatctttttttccagttcactcattctatacttgtgtcactttattttctacttttccattgagctatttttaggagttctattttgtccttttttcaagtctgctcttttctttttctttgttatttactcctattctttcattatggcttttagtcttacttttatcattttaataatttgaagaagtcttattttgttgtccatttcagattacagtattttcccagctcttagattttagtctaaaaaaaaaaatctctttatgactgtccatcatggtagttaactcctttatatggtatgtgtgtgtttgtgttttggcaagttcatcttcacagagatttatttccagtgggaatcttgtgaatcctgagttatgaaattgtccctatgcagtggtcatatgtttgtttcttttggtgattgaaggagtttcagtggtcctgaaaatgtatttatattcactgcttgtctcacacccagacacaccaataatgtaaattctgatcctacaattgaatgggattcatgtttagggttttcctttctcagaagtgtccaagctctgcatttaaaacagttatcttctttggagttcctgtcgtggcgcagtggaaacgaatctgactgggaactgtgaggtttcgggttcaatccctagccttgcttagtgggttaaggatctggtattgccatgagctgtggtgtaggtcacagacgtggctcggatcttgcattgctgtggctcttgcgtaggctggcagctgtagctctgattagacccctagcctaggaacctccgtatgccatgggtgtggccctaaaaagacaaaaaacaaaaaacaaaacaaaacaaaaagaaagttatcttctctccatcttgaagccgggggtgggggcaggggacagtggtttttgtctcctttcatggatagtgtgactttttaaggctttgagatttaggaaaatagttcgctcaatcctgcctccctccccccacctcacacaggaccaaggccacatctcttcatgggcgttagaatcagactgctgtccccagatccccagaagtatttgtgcaggtctgaaacttcccttgtcatcatgaagtcacctttttgttaaagctctgactttaatttgatcttcattcctggagcccatacttctctcccttccttctttccctcctagccctgcactgtgattttttttccagaacttcccatttttgtagtggaaagggaccataggatcagcccaatgtttgcaatttttctggaagttaacactcacatcctctatggagctaaacctgtaacatagtaaacaaaacctggaatcgactctaaagggccagagatcaaaagctcctgagatatcacttcatccaacactagcattttaggaaacttaggcttaagtctgatgaaactacttgcccacagatacatggccagtgagtggaaaaagctgaagacagatcgcaaaaggtagccacctttttcttattaccacatcacaggagaagcagcgtcatcaagcagctagctgttgtctggttgcaagactcctcagtgtgacaaatgttctgccttaaattactgtgagatttcgggagattgtgttggttttgtgttgttttttaatcttggggaatagaaagcagtaatccccacagaatcacttagatggtttttcttctgtcccaattttttttttttttgctttttaggaccatacctacatggaggttcccaggctagggattgaattggagctgtagctgctggcctacgccacagccacagcaacgcaagatccaagctgcttctgtgatctacaccacagctcacggcaacatcttaacccgcatgagtgaggccagggatcgaacctgcgtcctcatggatgcaagtcagattcgttaaccgcttagccacaacgggaactcctcaattttgttttcttttttgattttaatttttccaaagagtaatgcattttcccctctcctttcttcattttcttttcttttcttttcttttcttttcttttcttttcttttcttttcttttcttttcttaagacccaattcaggttccatgatctctcagaaatctcccctgaagtctgcagcccatcaagggttttttccttctctaactgcttttgacattgtcatttgaatcacctaattggccccctattataaatctgtctgaccctgtttaatgattgaatgtgatgtacttggtctcctcaacaaaattgtaagtgctagtttgcagaaaccgtgcttagacatctttaccatttcccaaagtgcttttcttgattaattgatgagtaaacaatttagaggaaatatgttccctgtgatagagcctgggcttggtgtcaggaagcctggattctgccccttttctcgccatcagttccctggtgtatttgagcaaaccatcttgccttgtatgagcaggccactgtaatctggcaattagattgagtggtcatgtatcttagctttcaaacagggacagttatgagagcaaaaggggaagcactacgaataattttacagggacaatgggtgtaacctgggactcttcctgatgagccaggacatatggtcaccttatgtcacagatcaccttgagctcttcagaaaattctgcacagatgctctcaaaataccagtcttgaaattaaaaaaaaaaaattatcatcccttataagacctcacgggtaataaagtgttttgttttcccagacgttcatattttctcaactactttcctggctttaaatgcttattataactgaagttaaagaaattatgggtttgagaattaatattattaagagaaaaatgcctttattttccatgtcaacaccactctctgtcctggaagaattttcagaattctgagccttgttttcttgggtgctttttgaaacataagctcttacctccagtataaccagtgatggaggaaaggtctgtgaatggttgttgatccccaagactgggtatgtcttcatgtaatggtgtgttcagtggcttagcatagtaggtgaggtagatctttaaaaagacacattataaatactattgctcactagctggctcatttctgcagctcttgccagaatgctctgtacacagcaggtgcttcataaatgtttgttggcttcaaattccaaggaacacttggaagacagtggtggctagtaaattcatttaccagtgctggtcgcttcactcctgatggtgcttagggagtactctgtgatgggggcacggtgttggaatgcaaagacaaacagatactatctcttccctctgggattttatgatctagagacagtcttagagctgtaaacaacacagtctaagaaagttcaaggaaaaaaaaaaatcagttttgacctaggggagttaggtggcatttgagctagggtttgaaaggtaggcttctactctagaacagaggtggatgaaggccatttcatacagtggcaatggcacaaacaaaaacctgtaagagtacaattgcttggaatgtataaggaatcttgtataagaggtcttgtgtgtctggaagataagatttaataggtgagatgtcctttaatgtcaaactagggaactcgggttatattatgtagacaatgggaatcacagttttggatttttgcaaccaactcatgtggcagaatgataacctggttgcagggagaccagtaatgcagaggctttggtgtctaggggagatagaaggtagccagatatgagatacagaattagcatgtagagtttaggaggagataagacccgaacatgacaccaaagggatgagaagatggtgacgccatgatgagaccatggaaagttggagaagagcagaactggattgttagggagctcttgaactctagggagctttgtgagactatgtgaaatagtgcataaaaaaccttaactgattctttgaatgaagtagatgtttgataaatactacattgaaggaagaagggaaggaagaaaagaatgggaagaaaggggtctttctctctgtgcatgaggccaaaacagggaggatagttaggggtttaggagatccaatgggaatcatgcactgggctcttcctgtcaagaacttgccaactacttatgaattgagtgcacaaaccaggagaggactcagaaagaatgaatgacccaagtttgttggggtcagatagggagaagtaggctttgagccagacttggaagaagtgagagatgtagggtgatggagggtccacaatgagccagagagggtagcctctcaggaggcaggaagggaacacaccacccacatggagaatgggaaggatgctgattagcatcagaggtagtttctgcaagtagagaaatgtcatgggtgagcgatgggggcgagggggtcatctggaggaggctagaatgttgctcactttctgacaagcctaccctgaaactgtcttggagaaccctgtttctgtgtgacaaccagcccaatgcctccccagttttctctgaccatttggagtaatagcagggcagtcctttgtgtgatcagaaaccaagtcacatagacttttcctgatgagccatttcaagatcactctccctaaatccttttattggaagtactggtcagtgctttgtcttgcaaaaatgccttttggtttctttccctttgtctttgattattggataaacattttagtttcatgattacatagtgtttagatggggcaattcataaatcggcattactaaaattgtttgccttcatttacattatatcagtcatattacatctgcttcaggaatgccagaaaacataaacatggcttattttgtaaactacctcaattggagcatctgagagagagagaaggcgtaaaatgtgggagttggcatgctgtctccccttgagtaggagaatcttgaagccaggaagttctctggaagccttctactaccaccttcttaaacccggtgcctcccatcctcttcctgaattcttctaaggaaggagagttctcagaatgtgccaacttttagagaaaggcaaaccacaaccgaataaaacgttaacattaatttctcttaacactaatctgaaacttgttcaggtggctacagtataaaatggatgaaagccaggagtgacctggggatactgtcatttgatctacaaaatcctagtgtttgctggatgcagtgcttatcagtgaggtgtgtctttttttttttttttttttttttttttgtggaggagagcttttcacatcttcttatcacataagttgtcttcatcttctatggtttccacactttggtcttttcccttggatattgtatctttcccagacatggcttccaagatgtggctgcatttagggatgcaatattaacagtgggttggtctctgtaattttggacgaaatcacctgtgtttttgcaggcatccgtataaagtttacaaaaggaccctgagacttagctgttcttctgcatcagtgtttcacttattcatcccttcctgtagaaaaatctgacgcccactgtgttcctttccatttccaccatttactcttcatttggggccattatcaatgctcactgatactattacttcaaaaatgggttttaatctctgtctctgggggccatgacataatatccccaaacatcaccttgatccttactccctcctccttaaaaccttcatggcataattttcaaaataatgtatttttttgttctgattacaaaagcaagatatatgtgtttttttttttttgttttttggtttcttttttgggtttttttgcagaaaattttaaaaatagagaaaagcgaaaagtaacgaaaacatcacttgtaatccaccaccaaaacaatagcctattgttaataggtggtacacatcctataagttgttcttttgtcttttctagcactgagagccttcctggtctggtcccagcttgacattacaatcttctctctctagttccttcctctctggggacctgtattaccttgcatagaacttttcatattcctcccaccccagtgatttttttctgactgtataaacaatacatattgttctaaatattttaaaaatacatttaagaaataaaaatttcatttgaaaacatcttagaccctgaaataaaaaccactgacgttttgcagactacctcatcatcagctgtttatagatgtgtgcctaagctcacacacatgatttcctataagtgagatcgtggcatccatgtggtttttatggttgatatcttctttcattttcgtttatttctttcctcccactcccttccttccctccaccctaatccctctcccccttgctgccaatgttattggtcttgtgtgttatccttctgtgcttcattccacactcatataattataccagacatttagatagataggtagatactatgtacgtgaattctgtcattgctttagaaaaatcagaccatatcatacgtccctctcggcatcttgtgtctttttcacttcacaatgaaaagagaacttcacgttgttgaaactcctccatgctttctttttcacaactgcagagtgtttcttggttgaccttagcaccatctattgaatgattctactacttactgctgtggtgagttttgaatttggatagatatttccaaatagatattaccagcagtgtaaaagtaccttttgtgtgtcctttcatgtggctatgacattgtcactaccaaggagcctctaaatttcaggggaggatggggaggcagggtccctttgaagtcccaaacttcaggacaaacacagggccataagaagaccatcactgtaatatatatcagagaattcattaaatggagatggtagtttactggagttgggttctggggaagaaatatttatagaaatgaatctcaagtcctaaagtgttcctttattttaggatgacattttttttaaacccaacaacattcagttagcatggcagctagaaatttccctcttggctttaattttttctttacagtttttgtcagaactcaaaaggttaaatacaccacaaacaacttctaaacctttgaatcaaccttgaaaaatacacagatggatgtatggcaagattggctctgactgagagtgcctattccatgggttacatttccagtgctttaaaaatacctgttcatgtggtggtcgaagtctgcaaacagatgggcgggttggatcctaacagaccatctcctgcagtgggatgttggctgcacctcctctcctccaagatggcagctcagccccattccctttccttcccaccacctgtcttcctctaagtctgtactgtctttctaccctcatcctgccactacttcggttgtctttcttgctttccttcttcttcttttctctccctcccctctcccttccatgtatcccagatttctcaactttcccacaaagaagcttggcgtctgcagctagtgcctgccattgagatggtaccaggaagcccactccacccctcacatcattttggatgcaacctgaaggtcattagccagtctgaggtattttcatccctaatttttctgtggataagctctccacttgacagaaaggcttctcccagcctccttttactgttttatctgacatcattttaggaccttgagtccctgagggcctaaggcatccctgtacttggaggtagaaagagattctatctccaggagaactcagagcaaccttttctgcaaaagactctgggcccctggtgtcccaccaagaaaagaacctctggattgttaaaggttattggagttgcatggggaacgaatgaggtaatctagactctagttccatcattcttcagtatcgtctcagtgtcagggaaagttatgagtaggattctggtcttaactcttcacttctgaatttactcacctttgtggattagacagagcctagacattagtttgagtgtgtgtgtgtgtgtgtgtgtgtgtgtgtgtgtggtttaatatgtacaacttgtctgaacgcagtagctctgtggtttatcttttactgagaactgctttttttctctcccttttctaagaaaatgctagtttcctagactgaagtctttcttgtgagtttgtcagcagagaggggtgttgtatgagggcctgtcggtgatactaagatcaaacagtcacccaatttgggtgactttgacacaaatactgttgactgaaatggtagtgagcatgtgatgctggcatgtgacatttgaatatttgccaagaaaagcacccaggacactgcgaccagctgcaagagtaagagatttgcctgttttactgtttttacctgcatttttatttgagaatctgaaaccaacctttatagtttggggcaggaaagtaacacagacagccagcataaagctgtttacctgcttttgcctttcactgtgtaaagaattcaggtcacttagtcttaatcaagagcagcataggaattaggggacatgatcttagcaagttcgaattttctatatgttctttcactccctgttcctgaaattcctttcaagactttttcatccttctggtaaaggtggtgacctgcatttgctaaagcttggaattcagacctaagatacctgggccccagttgtggcttgttgctgcttatcactatgagactcactctctagccttggttttctaatctttaatatgggacaccctacttcatgtggccattgaaaacatcataacttcgttccctgccctcctttcctttgaagaaactcagaatttccaaaactgtgaagtgcagtatttttagggcccacttagaattttcctgtaagaagagaggacaacgagaaatgcagtcttctactgttatagcatttaaccaccaccaacaaccctttccccccacccctggaaactggttgcattctgataaaacctgtgcagggactaggcaattgtagatagtgtgtcccctgattttcatgagttaagagcttccctctggcacttctgtagaaaggccttcacagaatgtagttctactgtgctggcagttgtgtcattagccagggagagtcagagattgcagccaagttagagtaatgccaaatgctatacctgtcagtaacatctgtcatgctcaagtgcctatttagtctaaagaactaaaatcaggctgcactccctaaaataaaatgtagacaacaagtgggtacccaaactacagcatctgccagagcgaatgttagcaaaggattaaggtgaccgcttgaaatatataggtggcttaaaaccagaaataaaggatgccacccacagggactcctgtgggctcagacaaccaggagaaggaagttcccattgtggctcagtggtaatgaacccgaccagtatccatgaggacgtgggttcaatccctggcctcgctcagtgggtcagggatccggcattgccatgagctgtggcgtaggtcgcagacgtggttcggatcctgtgttactgtggctatggtgtaggccggcagctatagctctaatttaacccctaatctgggaacttccatatgcagagggtgcagccctaaaaaacaaaaacaaaacaaacaaacaaaaaacgaaagaaagaaagaaaagaaaagaaaaccaggagaagagggaggtctgggttggaaaacaggatagctgctgtccagaggcagcctttggaggctctggaaggatgtgggggaagtaggccacaacatgacatggacatggtgaacacagagaagcctttgagccaaagacttggtgttctgggtgaggtggagagaagtaaagagaagggctggagattgggaactgggtcagagaacaatctggtcacgagtgaggacggagcgtgtgggttacaaggagtgacaggagggcctggtcttcaaagtcaggctaagcgcaaagcaacctgatttactcagtggagtcctgcagaaatgaatagaagaaatcagccccccgacaccagtgaatgaatggtgggggagaagtggactgagcaaagcagaaggctgaagggcaagataagctctttctgagacatatgactgaactgaaacccagataaaatattatcttttaatccaggatctttcattagacattcaatttctttgtatctcattcacaaaagagcaatatgcaggaactccttgacaatgagagtgttacgaactaaagaggtattaaccaaacgtactgggaaagtataacatgggaatgaaatttgaagccagtgataagataaaaaagactcaatgctaatattacattcactattttgtaaaggataaaagactatgttccctggggcctcagtccacgctgcgaccctcccccatcaccaagggatgagccctgaggcctccaggtaaggcctccatgatgcaccttctttgcacgcatgtctgcccttccagaaccttccagaatcttcctcatctccctgttactctgcaaagtatccttagggcgcccaaatcctggaaaagtttgcatctaattctgctgctcctttggattgctgtcatctctcttccccatgtttttaggcttcttacaagctgggtgggctgtgtctcactccagtccttcactctctactccccctgttctccctccacccttcccataggtcttctgcccccattgctcttctaaaacagctatcttctaaggggatcacacattcatcttctgtagcagttggaacccaagatacatctctcttgaaacactggaccttcttgcttctgttgcacaagcctcattcctcctcagatcttgctgaccagcccatctctggccagctccctggcttctctttctcctcctgcttgggtacagccagacctccatccaggcacagaacttctgctctgctctctgttccatctctcagatcccacctcctccctcaacctttctacttataggtagatggtttcaacctacctgtctccagacctgactgttctcctgtttccatcccatattcccaattctctgctggtcacatccaccaggtgatccatcaccatttcagacttagctctgcctcttccttcccaaaaccatgccctcccctgaccttgccagtctctggtcctggtggcaccttgtcccagtgccctcatctcagccagatttggttccatcttctcccttttttccatactcaaactctcacaccccatttccttcatttccaactatgtcttcatggtgttcctggatgtaaaatctatggatcatctactgaattcttccttgatctgcataagcagaacagttctaggtcaagtgatcattagtcaaatttgagtcatagaaccaagagtcatggcccctcagtcaattcccagacctgagccagtttacagacccatgagcccttgcatgaaggggaggctggttcctcttgagaaaggaccctgctgcactgcctgagatttctacccgtaatctttctcccagctttttccgaagggacccacagccttttaccagggtgatgggtatattggggaaaaggaaacaacagacctttcgaggaactcctgggcatgggctctgaattgacactaattccaggaggcactagactgtgggccacgggtcagagcaggggcttatggtgtcagtggtccccgtggttttagccccactgcctttcccacagcactctgtgtttgcttctgctcccgggtgctgcgctggcaccaatggagcatttatattccctggctcaaatcttccaccagtgccaggttctcaggaggaggccagccatcttagctggtggtgagagctctccataaagaagccccctcgctcccagcctttgtggctgcaggccctcaacccagtacttccctgtccccaccccgactacagtccccaaacatggctcactgtccttctcactttgctctgacactcttccccaaaccttcaatttcttgtcacctcccttctctagatccatgaggtgcctgtttttagcccaaatataccatgttctcttgtaaaaccttttttctcccctttagcttgtaacagccagggaaatgagcaaaatgtgtggatggatgaattcaccagtgttggggacaggaggggtccttctctgaggggtcgttagcgatcttcataaacaaaaggttgccttgtttatacctgttcttcagcgtcagcatttcttaaatctgcttcaggagaaagtgagggctttgtgtttaaaaaaaaaatcatatgggaagcacggaaataagaaatattcacttaggttaatgcgtgagtctgttccacaacaggtggcctctcaacttgcacaaataaaacagaattggtcggttgaaacctatcaacagagcagacgggataatggccaggtggtgggtccaggagcagatggggaatatttacttagatcttcagcacttcttgttaagagtccctctaatacagtaccttccctaggttgtgaaatccactgccatgctctttgaatactagtgttttgtttgtttgtttgttttttaaaggtaattcccatgtcagtgtctcttttttccaaagttggagttagagtaaccaatgtcagtggagtttgtgcaaacctgaacatcccaagtttcctttcagacttttattaaaagtttgcagatctcatgaaagttaaaaaaacgtagaagttaaatggaaaatattataaatcccagggattttttttttttatgccgagtaaggcagtgctaccctgggggtctgtggagacttttccatggaggcagaaccttttagtgatgtgctcacccacccaaacagtctggaacccttgggtcttcaggaaagtatataattctccatgtagcatcagttcctgaccatctttgagttattctgctcctttgacaaatgtgacctggctctgttgcagttttcttcctgcttctctgaccactgtgtttccccttccctctacaaagagttaggaagcattcatgtggcacctactggggaccagagccacactcacttgcggggacctctacaaagatgcgccaagcccagccctgcctccaccgctgcttcctgcatcctgatgctgagctcatggagtggtcccgaggctggtccctacttctcctgccctgtgccttttctccttcacaaaggcttttgttctcatagcttccatcatagtcccagtcctactttctcacttaagtcgagtattaacatttccttgttttctccaaaattctgtgtgtcctcaggacgaccagctccccatgggcccttctgcttctgtcagaaggggcacaaacttcctttttttccagatatgaaatatggaaagcatccttcactatcctcccctttctcttctgtgcccaggaatcattgttcaggctccctctcacctgctctccattctttccttctttgctgttcccactgcctcccttccccattcctgatgactcatgcacatccattggggggctctccacatccaagctagtgttccctccttgaaatgccctcttatcaatgttcctcttattaagcaccagaaatactgtcttactctttcatatctctgacagcatataacccagctccttgcacataggaggcacataacccaccttcgttaatctcttgcggcaaaagcataggtgctttgtagcttgttagccttggtttttccactttcttcacctcacagaacctccaaagggtgatccccgtggcgagagttgtgttagctgtgggagaagtgccacaatgcagagagcggtgaaatggatccacacgtggggaggtgaaattagggaggaaaattcaggaactggaattatttgataaaggagagacagagatggtgagaacttaaagacttcgggtgccctggccctctggagacaattgtatgtatacacaccaattccgcccatcctttaatacccagccctggaccaactgccttgtacttttgcctgtggctcttctcttgtttcgtgttagtggagcacagagagcatcaaggctgttgcaagatgcttgtggatggtgggcacagtccaggacgcatggggtggggggtggctccacatgccgactgagcacatctgggtggggagatgtggacacagccatggaggtgactcagagctcctccttaaagaagttaagctttcagagggtcagacacagatagtgcaccataacagaagggacagagggggaaggcacaggaggaaggttacaggttcaaagataagtgatgatttccagtgagaataaattgtcaaaccccaaagtgggctacagagaaagctgtggcctcctctttcctggaaatggttgagtcataacagacaagtgcttcacagtggcctgagcactgacttctctggaggtctgaggatgggagagagaaccattcctacaggctgcatatctgggttgctgggtttgctttggagtgagttagctgctgcttactcaaccacagaagtgaaatttgttactgatgagaaataataaaagatctttctttttctagacttcctctatgggtgttgttgttttctttctaaatggggggatttgttttgcttttttcctttcgtggcattcaaatttagcttttgcgtatatcctgcccagtagttcagcgtaagttgatgagaaaagccaggccaaaatacgatggatgctcaccattttcctcgaagatggtatgtagcgtgtctgtgtgcatgggagaagtcaggctggtgaagatgtttgagaactcatcagcattcacaaacgaggcctttagtgatgtcagaatgttggctacatctttgactcacttactctgtgccctgcctgcacggcacttgccagttgcagaaggaaaaaaaaaatgcatgagacgtgatccctccttttaaggcacttagaatctatcaggcaagataaactgtgtttgcaaatcatcttatgtattacggagagaggattattctggttcaaaggaatgccattgtgaaggatgacatcatggtagaattgtaatagtgaacctgaaatccacttgttcaatctttgtcatttctatcttggattagtttgatttttttacttaaaaaatattatttctgaataagtaataggttcacatggtttatagcccaaaacaatttagaaacatttttattgatgaattttactccccaactactcaattcactacccccttactccttgcacacaggtaactgtgtatgttaatttcttgagtatatatccagtgcctctccctgcaatattatatacatataaatatgctttttttctttttacagtctaacctgtgacatatggaagttcccaggctaggggtcaaatcagagctgttgctgccagcctgcaccatagccgcagcaacaccagatataagccccatctgcaacctgcaccacagcttgtggcaatgccagatacttaacacattgagcgagggaggccagggattgaacccgcatcctcatggataccgtttgggctcttaacctgctgagtcacaatgggaactccatatatatacatatatacataacattttcctttttcctacataaaaagcaggcttgatcttcacttggtctgttaatttatcagtgtatcttggagaccttagcattcagcacatcttttcctttcttcctgtatagcatactaccttcatagggctttgctgtttggggggatatcatggtgaatccattatctattgcttcatgacaaacgggtccataacttagtggcttatattaaaacaatgactttatttctttacagtcctttggtgggttatttggactgcattgggctgggcggttttccttctggtttttcatggatttactcctgtggattggatcatctggcagcttggctgggccttgatggtccatatcagtggtagaggccattgccagctggattaagtgtgtacaggagactggtccaggcttcttcccatggtcactggattctaaaagcagagaggattatgccccactgtaagagggctcactaagcatctgcctgcagcacagttgctaatgtcccatcaccccagcagatcacagggccctgtgcagcatcagtatggcaggatctgccccagggagtgaacactgggaggaggcgttcactggaggtcattatgtaaccatctcacccatatgtcaaataaccacccctattgatgggcacctggttatgtccaaccatttggtattaccaacaacaatccgtcagtaaccttgtccatcagtccactcatgtgtgagcaggacacgtcaccaggagtgttcctgtggcaaagggtaaatgctttttaaatcatctatctattctatttctgtggtgctatttctccagttattttaagcttgtgctcatctgtcatttttccaggagctttgaaaatgtaaagagtttaaataggaaatacacctaaactgaattcattagaaacccattcctaaaataaaaaggacgaaagctagactagaaatcaaatgattctgaataaagtaacatgtatttgaataaatgtctattattatacagtgttttacgtttctattgtttacagtatagaaacagtttgtttagagtgccttatttaattctcacaattctatgagttgaaggtgtaattggccccattgtgtgtgtgtgttatacatacattatatatatacatatatacatatgtacaacatgcatatatattctgggtatgaacacacactttatatatatataaatatatacatatatatttatgtatatatgtatatatgtatatatacatatacatttatatatttatgtatatgtacataaatatataaatatatatatataaatatatatatatatatacacatgtgtgacatacatatatacttgtatttttttctcttttaaaacttagagaagttacatgaattgctcgaactagcaggttatagccagggtctatatccagccttgtgacagtaaacttgacttcttccccttaactgcatctcctttgtaaggacttgtatcatgtcttagcttagcctcaaatgactttcatttgctccagttgccacatgaatacatcacaatcatatgagatgtcgtttccggaggttcttttttaaaaattagaaatatttcatttctaagttctaaatacttgggaatcatccctaaagttttctcttgtttttcacatgacattgctgatagctccatatcctgatctgagtcattagtaaatcttgaaggaggaatgctttttaagcccatgtgcttgctttcagtcttcaggaaagaggagggagttgtttttaaataaaaccttgtctgggcctccagcagcggacatggaaagtagactgttgtgttttgttttttttgtttttgttttttttttttttttcattcacactcagatgttttcataggggcttggtcacggcaaagtgggccccacatacaaaccacccacttccctgaagcttgattgatgagcaaagctgttctgcctaagggcagcctgatagcctgagcctggatgatgacaggtccgacaggcacagatttgaatccaggtctcttgccccctgactgcaggctgagggccaggacactggttcttgaggcaggagagaggaagaaggatccactttggggaacagggcaagctgcatggattgggggtcacccccctttctagaatccttgaaaacgtggcagctcaggccaaggtcttccttgctaagagagctcccactggtgctgcgtgccgtgaaaaccaggctgcagaagaactgtgacatgcaggtgagtggaaggatgcttggccaagcctgtgcaaattggagggggtcccatctgaacctctaagcatcaaagagggtcatacatgtcaagagagatagaaatttggtgccgagtcaatggaaactatgatggaagtttggaaatgcaaccgagcagggacactgtaaacaggatgagttgggaccatgtcttttcacatttgcctccttggcatatccagcggagcgtcatttatagagtagactctacataagtacacagcccccaaatgctaagctttgacgtaaccttggaaaccatcatgcccaggctcattttagagaaaagtaaaccgaagcccaggaaggttcggtgaagggccacgggaggtggggggtggggtgattgcctggtagagagcctgggcttctaaatcttagtaaagttagttgtccatggattgtgctgccagtgttctaatacaggttaagagaaggagtgaataaattaatttcctttttaaagaagcctggttgaaagttactcattcactgaagtcacagagaatgacccacttaatttatttaaacatctgctaacctgagcgatcactctagcaagtacatcctgttgggggtggtggggaaacaggggtatgtgagaaagaattcgttagtgtcttttgaaagactttcaggaatctgggtttcaaaaacattttgcatatcttacagaaagccttacatgtcagtgttggatgaaaaaaagtggatttttctaacagtgatttgttacaagttcaaggcatggataggctggtggggaaaaatgaacccgaggttaagcatagttttggtgcactgtagtgaatgggatatcaggtagcaggacgagcagacatctttaaggaggaggcccggatcttgttcttggttcctctacagggcagcaggctcactgcccatgtcacgctgaaggtgcatgacttgttccaaaccccctgcttgatgggactgagggctcactggattcagacattcagccttaaagccaccctttccttcagagcttaatttttcttccatcacatggtccactgtcagttttctatcatctttggctcttggcggtctggctgcctgggatggcagggagaaactctcctggttgcctctacacatgcatctgctagaatctgttgtcatgaataaatgttgacatctgacaaaagagcgtctaggaaagcttcccttcctctgcaaagtgtaaggggtaagtcattatctcccttttttggatataaatcaggtatcattctgccacccactgagaacattttagaagcccatttataatatctacctcactgcctcatgtttggtttcccgtttcataaagaaaaacctgcaaataaccaaaagtagggattccagtgaaatgtaggttctatttcactatatttggtgtagggattccagtgaaatgtaggttctatttcactatatttggtgtgggaggcagtgtaactctaactctaagaataccggttgtggtatctatctacattctaagaatttatggaggcgaggtttgtaccgaattaaatcaccccgtcgtatctacgaggcttcctgtagaacgaaggtaaaaatgaacccaaacaaacaaaacaggaatgtgtctcaaaacagagacacacacttctccagcagtaaagattttgaaatggtccttgaaaattttatcgcagacctgctcactagaaaaaaatgccttggttgttgttattgttgttttgttgttattgttttggttttggttcttaccacctgtatttaccccatttgtggttgcaaacgttgaaactttcttgataaaagggggagggaaaataagatgctgctgcccacagcacgggagaggtggggccagccggctaggaagtatgcatgtctgtgtgtatctctgtgtgtctttgtgtccatatgtctgtctgtgtatgtcgctgtgtgtctgtgtgtattcatgtgtctctctgtatttgtgtgtttgtgtctgtgtatgtctgcgtatgtttgtgtgtctgcgtatctgtgggtctctgtgtataggtctgtgcgtctatgtgtctgtatgcatttgtgtgtcatgtgtctgactgtgtgtctgtgtgtgtttgtatgtccatgtgtctgtctgtctgtgtctgggtgtgtttgtatgcccatgtgtctgtgtgtgtctctatgtatttgtgtgtctgtgtgtgtgttcatgtgtctgtgtgtgtttatatatctgtttgtgtgtctctgtgtttatttgtgtgtttgcatgtctatctgtgtatgtctgtatatgcttgtccatctgtgtgtctgtgcttgtgtgtgtttgtgagtctgtgggcttgactatgtatctatgtgtgtgcctgtgtgtgtctgtgtgtgtcagtgtgtctgtgtgtctctcttgtgtctgggtgtgtttgtgtgtgtatctgtctgtccctatgtgtttgtgtgcccatgtgtctgactgtctgtctgttgtgtctgtgtgggttggtgtggatgcaggtacatagcattttcaggttaaatcgtcttccttcagcatcaccattttcctgaacctgaaattactttgtcgtgaaagcaaagacagtgactttcttataaaataaggaccaaataacttggcaagctcaaataaaatccacccttcaacccaatattaaagaacgtagaaaatcccacttgacactgaggaagacagaccagtttggtttgagtctcttacttgtctgtatttcttttcacccccagcccccatttgcccatgaaaaatgctgtctcaccgactacacatcccacctctccatatctgcctggtaacgaatggcttccatttgaacttaaactctgtggtggtgattggagaatgatgaggatgagatcctgaacatgacattatcttaggaaagctttcctccctgcctcctgcctctccctccattgctgtttctgtcactacccccgcttcccagatgtgagcttgcaaaagctcaaccctggcagtaactgtcgctgcccccacccccaggcaacaccccaaccccctgggagcttcacagaaagtgcagcaatagtttggcttccaaatgcatcctgccagattctagcaggacacattgcagtaggagacgggaacacaggagcccccaggtcatcagttcccactgcatgacggaaacagagctaggggcttgccttgcactacttgagtcccaaaacccataggcaggtaagcggtctcctcattttcagaggaggaaaccgaagttcagagaaagtaaatgatctgtggctgatggcaccactccgaagggacagcctgtggcttcagctcagggcaaatgctgatggttatgcttcgggcactgcagcatcctcaaaagaagccaagctgttaggaacgcactcaaatcgattttcatccacatgaaatggcaggcgtgtgatgccaaaccataacattcttactggcttcaggaagatgttatttttttctcacctgtgttgctataatcatcctattctctgttctaagaaatcaaaatctacaaagaaaacatatttgaagaattttttttgtcacttcttgttgtgagttgaagtctgacagatggaggttagatgctaaaacattgggatttataaaaatgattgtgtatgtattaataattaagagaaaaagttggttgcagtacagaattgagaaatccgaggagttcttgtcatagctcagcggtaatgaacccaactagtatccatgaggatgtgggttcgatccctggccttgcctggtgggttaaggatctggtgttgccttgagttctggtataggtcgcagttgcagctcagctcctgtgttactgtggctctggcgtaggctggcagctacagctctgatttgacctgtagcctggaaacttccatatctccaaaaagaccccaaaagaaagaaagagagagaaagggagggaggtagagagggagggagggagggaggaaggaaggaaggaaggaaggaaggaaggaaggaaggaaggaaggaaggaagggaaggaaaaaagtaaaatctgagaaataaagcaaatccaagctgaggggaatatgtagctataatatgatgcttccaggtgtaggaatcttcaggtttgtctctgccccagtcttctggaaaggcatctgtatttcacctcctgtgataaaggcccatgtgtctttcttgctgcctgagttaactaagcatattaactgcactaaatgctcagctctccttaattttccttaggcttggttggctttgatctttacatttcaaggccccaaaagaccagatagagggagaaataatcacattacatctcctcctccagtatggtcgcttcaaccccaaaggatgcctttcaatcaggaataagggtttaggaaccaagtgacaaagttacacaactgaactttcccccccgcctcttttactaatacttaattattattgattgttttcttggctaaaacccatttcaaaacctgcacaaatgaactttttccgtacccaaacctttgaaaggatatatttgaagtattttgacgcctaagagaatagcttctaaacaagttatgcattgatttcctcttaccctgaattattttctcgcctgattttcctgaggttgttcctgaaacattctttgtggttcactgaacacaaaaaacaaaccatgtaccaggtttggtgggaggtgggggtggtttctagggatatgggaaacacggcatttgttttcatggagcataagtttcgtggaggaaataaggcactttgacaaatagccataaggtaaactagaaaattgtcaagtgctgtaattttaaagctgattattacatacctaaaagctggtcaaattacagttttattgaatgctaacgaattattactcccctcctgcacagaatttttcaaactctttactttctctggcttataattacggtaaccacattttccataccccaaattaagatacacggtctgacaaaggattcttgtaccacttctaggtgtgagaccacccatagtgaggttttttctttttaaaagcaggtttttttaggccagctctataaaaaaatagaggtttgttaaataggtgtggttttagacttttcattaaaaacctaccatgcaaacagtattttattttgcatctgaatcaacatgttatatcctaaagcaggattttatagcctaagggtatgtgttcgcctattcataaaaacatactgctggatagagtaataatacctgccattatccaggtgtaataaaaaggtcccaagggttctgctcagggtctttaattttccttttgaagataaagctccttatttcactttcaaggttcaatgtttttgaaccttgcaaatgattaccattgaggcatgccagatgtgagtaattgggagcagtagttcttgaaaagagggtgaaggagtgactttttctttcttatggtctctccctattatcatctgtggtttctatacatgtaatttttcacacagcaaggccatgtggatgggtagtggccagcctgccgtagtctagacatgggacttttgaactttcaaaggtaaggtaggcctgcgttgataatttaaacatgatgaaaccaaggcctgcttgaccaaatattaaatgtcttacccaaagccacatagcctgtcagggcagagccaactcctaatccccagctctctctgaccaaggtaggtttctattccctgccatgatgttttcttctattctaaactcactttggtccattcccaactagtctgatatgagggcagccctagtcctggagaggtaatgacaggaacgatggccttgctgcggcccggactcctcaggctcaccctcagttggctggaagttgagttcaaggcaagtcatacatggtgcttcccactttcctggggatcattgacctgctgacccaggagcccttgggactagacttgtcccataatgcttgacttgaagttgaagtaccaattactgcttttttcaatagatgattttgatcacttgttttgtaagagggctgcatttataagttgatgatctgagtgcacttttagaatacatccttccatcaaacacatatcagacaattaagctattaagataaatgaccttaaaaaacaacctcatgtcgctataatcttccattcattcattcgcccagtgaccattgagcacctaccataaggcaggcctttttctgggtgctgaggatacagctgtgaacagagaaaaattccagcccttttgcttctatgccattggatggtgttaataaattaaaacccttagcttgctaagaatgtggattaccatagaagctgaatggtaaaagaaaagtgatctgacatttattgggtatctgcaactttgccatgtgctgtgttaggtactttatctcatataatcatcataacaaccctatgaaagatggatctgattatctttattttttgcagatgaggaaccatggtttaggaatgtaatctatcttacttaaggtcaggctataaggaaataaatctacatcagtcttttcactaacatgttatatgtggtcatatcagtttagaaccatgtatgtgatgtatggacaccagactgttgtggaaaaataagttgaaaaaccttagggcacatttttactgatattaataatacatagtaatgtcatttcattggactcgcttgaaatagctggaatttagttattcagtccatattcccctttttcccatttttaactatgtctagatactcatgtcgcaacagaagaaagggtgggggaaaaaactgtaactgcaatgtatacatctaaggatgacctgacccccttgctgtacagtgggaaaataaaaaaaaaaataaaataaaaaaaaataagaaaattgacagaacattgcaaaccagatataatggaaaaaataaaaatcatttaacacaaaacaaaacaaaaaaaataaaaaataaatttctgaatagcaataatcactgtagtacatctcctttcataacatgcatcttccctagaacacctcaccctagattagctgttcaatgaccacaatgacatgtgcttctcagataacacatgaccttgcatttggctcagaacttagtggttggctctgctaaaaataagtctttaatggtttattaagacattcatcatggggtgctggtatttgggagttttcttcttcgtatcatgaaacatgcccatgtatagctctaggatttattaaccttgtttctttgatgaaacgccttaaggatttcagagatccttattttattcagtgaccctgtatttttttgccccccaaagcagttaacacaattatgggatctgctagtgctcggggcccaaacccttcagtgtgtctatttctggggaggagcgagaggctggattaaggctgggagttggggcagcgtcaaggggagggtcttttgctgactttggtcttgaccaaacaagggttgatgaaacagcatgtgctatggccgtggtgtcacaggctgatgtcatcccaagaacccagctgtgctcagcacctcgcttgatgtggggggaggggtgtcaggagacaggtgcacttcagctgccccttctccccagtgtctctgctcatctctctcatctctctagtttggggtctttgcaaacgagttgtgtttatgttcatcttatcaccccccactgcttcctgtcactctagggtactccccaggctcgtcgtctttctggtttaacaagtacgtcactgcctgaccccttcacagctcctcaagctttcatgagctgcatgggctgatcctgatcctgtaacacaacaagcttgcctctcagggccttttgccatctgtcacctctgcctggattgtagtccttctcattgtcttgggactgctccttgtggcctttcaaatccctgtttaaatctcacttcctctgagaagcgccccctgaccactgggtccttctgtctcctctcaccctcctttcatccgtggatgttacagtcattgcttggcatgtttattctttcagctccatgaaaacagggaccacgcctaccttattctttataacaccctctgcactcagggcatcagcacgtcgtggttgattgaacagctgtcaaaggaaggaagggggcactcaaactgtaggtggtttccatatcacaagctatattttagggtattttttaaataatgcaaaaggaataaaaaccaggccctttaagaaatatttaatatttcacatgtacttcaacgtttagcgacttctgattggtcagagattaatcagtcacatacagcactctgtcctcaggggatccaagtgcactgctcttttaagctttgcaagcaaactctcctaaaaccttactcgctggccctgatttcagaatctccacttaatgcatcaggaaccctcagggcttatcctggccttcagtgctggtttcacttcttcagtagcagctgctctgcacggatgcccacagtgagtgatttcccccaaacctgcctcagatgcttaaatggagtttgatggatttcacacacacacaaagcactttttcatttgagtagcttagtgacactgttgaatacaaatgatctgttcctgaatatcctggaacctcatgaaaatttttctagctagaaactggattcagtcaaagataggcctgtcatagactgaccaaggggattcatagttactaaaagagagattctttttgggggtggtgggggctcatggcgtttggaagttcctgggtcaggaatcgaacctgtgccataacagcaacctgagccaccacagtgacaacaccggatccttgatctgctgaaccacaagagaagagattcttaaagtggtttcatttgctggggcagcccaatggtttctagagtccagaaaccatctctagggccttggccttgagcaagggtgctgggtgaaggcctccttcctctgtggagggaagggaccgtgcagggcttgtgatcctgctttctgaaggtgagacatgggctctggtgatcagagacttcacttccccaggactgttggtatctgacttttaaggctaatggaacatgtctttgtgcttgaagttgtaaccttattaatttggggaggaaatgtaggttgtgtttcaaaaacctgacttttgaaaaacttttagaaaatgtaaaaaattacagaggggtggatttcctgctgtggctcagcggtaatgaacctgactagtatccgtgaggacacacgtttgatccctggacccgctctgtgggttaaggatctggcgttgttgtgagctgtggtgtaggtcacagatgtggcttggatctggcattgctgtggctgtcgtgtaggctgccagctacagcacagattcaacccctagcctgggaacttccatgtgccgagggtgtggccctgaaaaaagaaaattactgaggggctatcttcatattagcaaatcacagagagtatatactgtggcataaaattacgtagtcaagctttgcattccaaaccaactacttaattgatctgatttcaacagtgtactgttaactgggggacatttatcaagcatggatttaacagggttactttggtttctgactagggggagtgatgggaaacagctctttttcaaattttttatcctgggaggtgggcatctattcttttgttcaatttgacagttggagtgaagaaccagaatttttttttttttttttccttttagggctgcacccccagcatttggaagttctcaggctaggggtcaaatcagagctacagctaccggcctacaccacagccacagcaactccggatccgagctgtatttgcgacctataccacagctcagggcagtgccagatccttaacccattgagcaaggccgaggatcaaacctgcatcctcatggatcctagttgggttcattaaccactgagctacgaagggaactccgaagaaccaaaacttttgatgatgagatcaggggtgagtaatatggtaaatttcagttgaagtacagtgaatgttccagttagctagaagagtgaggtgtcctggttaattcaaccctcttttaacctagactacttctctatgactaatttttatagacttcaatacaaaaaagatacctaacaccaaaatgatacatatgtatgtcttttaatgatatggaagatatttgagggtttccccaagccccagggtcatcgagatatcaattatctcggaaaagtcctttggtagggctttggggctgatagaagaatggtctgtcactgcaggttggaactagcacttgtgtttccttgggggagagacgaggtgggggtaagtggggagctttgatatcttatttctgttggccagaggtgaaggacagttcttattttcccacgtctcatcaggcaatctgtgaagattttattgggcttataaatactcacaaatacacagaccctaaagcgataatgtatgtaaaagtatttagtgccaagtctaacacacagagaaaacttcagtcaaatgcaaggtaatttgaacaggtttaactgtgtttcctttggtttatggttgcttttttctttggggagtcagagagctcttcatacacctccttcttagctggaggaactttatttgcctcagttaggaccgccaacattgtttacttttttaaaatgaagcatctgctgatgagaactgcaaggaactaccacaaatttaagagtaaataagtcagttaccattatgacttcaggttgtacctttatctcagggaacaagtctagaaagagagagaattaggagaagcaagtataaaaaagtcttttttttttcatactcttaaaggaagggtaattggaccttaactttgaaaatactaaggttacgtactctttgactcagcaatttcacttccaggaggtttttctacatacacggaaggacagccactgtggcgttatttgttttttgcagtaaaagccaaaaaatgaacaaactgggtgggggggagaatatctgtgtaggggactggataaatgatagtaaattttttttcatgaactaaaatacagctgttggaagttcctgttgtggcatagtgggaacaaatccaactgatatccatgagtttgcaggttcggtccctggcctcgctcagtgggtcagggatccagagttgcagtgagctgtggcgtaggtcacagatgtggctcagatctggcattgctgtggctgtggcacaggtcggcagctggtcttgacccctaacctgggaactcccatatacagtggccctaaaaagcaaacaaaacaaaacaaaacaaaacaaaaaaaccacacacacacacacacacacacacacacacacaaaacacagctgttaaaaacgtgatagatatatatgaagtcacatagaaaaatgttcagttattttcgagtggaaaagttgaagtctatggagcatatgatctcatagatgagaaaaaaattagatacatgagccctggtgactcagtgggttaagggtctggcatcgtcactgctgaggtgtgggttcattcaatctacaacccaggaacttccacatgccgtggatgtagccccccaaaaagcagataaatgtgtgtgtgtgtctgtgtgtgtgtgtgtgtgtagacataacattttctggaaggatatacaatatatgttttgttaatacagtataattataattatgggtattatgaatttaaattcataattaggacaaatgaatacaaattaagatcagttgatatacacatattaattgcttatagcaaagtgggtattattaaattacttaaaagtttgctctcatgtttgttaagtatcttctagcttgcattctaatttacttattcagtcttgtatgattatcacatctacagttaaacttcagtcaagcttggagtcattcctaattttcacattgatgtttttatcgattctctgacagtgtagcagatagtggtgatcacactggtcacgacttactgaagccccacctgtgtgctaaactcttgtgcttgtattttctctaaacctcacaaaatctggaaagatgatgtggaaatggaggctgtacaaacttaagtaactcgtcaggaagctgaagccagcaagtttggaagctagcactcaaactgggtcgaactccaaagaccatgctctttccatatgtccttctgcaggagatatggtgctggtgaattaatttctcagagactctattttgctgttgaaacagatgattttgaaaaaaaaaaaaagctgtaacagcaaacacgctctaattgtttgctcttcttcttgctttctagcacattccattcaccattgttattaactatttattctgcgcctcacatttgtctgaactttgaacatatgcttacaaagctgatggaaacttcccaagcccatttgattctgctgctatttccagagtgtgaaccaactcgatggtagtgaggccaagtgcagcgtgccatctgagaacgacttcagcctttggggttggacctgattcagatgagaatgccataccgttgtttattttcttgagataaagaataaagaaaaatacgagagcaaagtctgctcttgaaaacattcaagtaatgtaatttttattagttgaactaatgttaggcttggcctggttttgcttctagagatttctagttccatagggtacacccagggtggccacgtagaagcaacagtaccactcacaggacagcccttccaagtccctacctcccttcttgctttgctgccaaccttcatccgttctttccttcaactctttcctaagacctggtctttatctgaaggtgatcctgatgttttcaacccagtaaggtgagtgagatggacatagaggaatgtgtccacagaataggcatctgacccagctttaggaaaggctttttagaggaaatggtaatgattgtgagtcctgaaagagaaataacagaggcacccagttatctaggaagagagagaagaaacgccagaggttctcccggagaacttggtgtctctgtccagctgtgtctccaagtgtctgaccatctctctttttttttttttactcaaatgaatttatcacatctgcagttgtataatgataatcacaatccaatttcacaggatttccatcccacagcccaagcacttccccccaccccccaaactgtctccttcggagaccataagtttttcaatgtctgtgagtcagcatctgttctgcaaagaagttcagtctgtccttttttcagattccacatgtcagtgaaagcatttgatgttggtgtctcattgtatggctgacttcacttagcatgataatttctaggtccatccatgttgctaaaaatgccagtatttcgttctttttaaaggttgagtgatattccattgtgtctatgtaccacatcttcttgatccactcctgaccatctcttttgaatgaggatattgactatgaatcagtcccttgactttgttaaagttcttcaaatcagtagactagagtacgtatcagttgactagaatacgaaaacattcctgagggagctcctgttgtggctcagcgctaacgaacccaactagtatccacaaggacgtggttttgatctctggccctgttcagtgggttaagcatctggcattgctgtggctgtatcgaaggttggcagctgcagctctgatttgacccctagcctgggaacttccatatgccacattgtggccctaaaaagatgaaaacaattcctggaataaatgacttttttttcccctaaatactcctcccacatcattattgataccatgggtacttatgacgcttacatctcccatatctgtcccatcttcctaaattcacattggcaggtgatgtacctggtcaaggtgaaaactttgaggactcatgtagactgaaacgataactgccatttctgcaaaagggcctgttggtaaaatattctttttgcaaaccctgggaaatgcataggtctggaggttctgttttcagtaacaaagatggatactcacaggaggggaggacagaagaaaacagaatgccccagccttaggctcggcgtgtggactgatggaaacatcaaatgacaactttcccttcatttctcttcctgtatccagtactaaggcaggcatctaaatcttgagttgtattaacgcctgacaatgtgtaaacatagtttcccagtttatatacatcatagtttggtctctcatctacccttcaactagtcaaggaagcccttccttggagttcttttccttattctatttcaacacccaaatttgttttttgcccatgcatatgaaaactaaaaaagtgaagagcaaatttgaaagtgtgtttcaatgcacgaatcaacctgacaaaaggagaatacacgtacacacacacacacacacccatatatgcatatgttatattggacttgagaaagccagcagagaaaaaaaggcaattgcattacaaggtttttttctttttacagccgctcctgtggcatatggaagttcccagactagggggtcgaattgcagctgcaagtgcaggcctacaccacagccacagcaacgccagatatgagccatgtctgcaacccacactgcagcttcttgcaattctggatccttaacccactgagcaaggcctgggatcaaacatacctcctcactgacactatgttgggttcttaacccgctgagccacgacaagaactcctgtattacagatctattctggttccaggacagccatacatggaattttaaaaaataattaaaattaataattaatattaaataataattaatattcaaggacaagagtagtcctatcatacaaaatgaatttagctgacagagaaacagtaaaaatactattcttttaattgatagcaaatgtccactaattaaaaattaaagataatcagtcattctcttaggtaaaaaacctagttggaaactgagaatcctgtagtaaatattaagcttttttgggtccattggtcatatgtgcataataaagacagtaaattgacataagtatggccatgatgaaatgtggataaagcactttgaactccacagaagtaagcaaattataaatagatagcatgctcaggcagagagaaaatcaagtgctattttagcacttgggctagtgataatttattgttcaggctctccgtttgagtcaatgtttatatggcgctgtatattaactgagaccaaaatagtctgtacacatcactgtcttggatagattactgagtgatcagcaaaaactgttccaacccaccactcccctaccagcaagggatttataatattttaaatattcgtcctaaaaatccaagctgttttgacaatttgttgggtaatacatctggttcaaagagaagcggtgtgatagatgtaatggaaaaagacataaagtagttaacattccaaactcagggcccaggtttcctggattcaaagctccgccagttactgtctgtgttgaccttggacaagttacttaacctctctgtgccttgttttgcttgctgataaggttaataatagtaccgacttcactaggttgttgggaaagtgaaatgagttattacaataaagcatttagaatagtgcctgatgcagagagagtgtaaactgtccttgtgtctttcctcaccccttttcccttctgcgtgggtagttttcagtgaccattccttgagcaactcccgtatgtcaagcactttgtccccactccacttaattttgcaaaaagtcttttgggttcaactccacccaattctggctcactattcaatccgtttgagcagtatttctttcttttttttttttttttaatttttaggaacgaacctggggcatatggaagttcccaggctaggtgtccaaccagagctacagctgttggcctgcgctgcagccacagcaacgtgggatccgacccaagtcttcgacctgcaccactgggctgtatttttatttctgacgttgaatatattggatcattttatatttctagcaccccaattaaatcgtgaggaagcatctctccttctgggcaacctttttgactggcattcagtctgattatatcagaatcaggcaaggctgaaggattaaacagatgagaatttctatgcgatgtgaagtgttccatgtacctaaagagcagaacagatgctcagtgcttccataaaatgcatacactgcatccagagattgtaaaatgcaggtcatttccgaatcttctgcaaaatacagtcttcattcaagaaaaaagtataataattctggaagtagccatggaagaccaactatctgttgggctgtccccacagaaagactaagagacctaagagggtggcatcatttgctgaattcaacccactccagggtctgaacttcaatctggcacctcaaagacctgatttattcactctttaaggacagattgatccatctcttaggggctgactcccattaacagctccctgggcaggtgttcaaaccaggaggccactgaagtcatttgtgatgagacacctgtgctaacctgccccaacccatgctgcctttctctcagcaggttttcttgggaagccagatgggcttcagaggtagcttggtaagcacagaatccaaacaaagaaagttagaaaactgggttggtttccagataatggcatcaaggtgacttcacatgctttctcctaagattgacttggatagttggccagggttgccatggaaatcaccaagatggggagttccctggtggcctagcagttaaggacttagcattgtcactgctctggctcaggtttgaaccttggaatggggatttcttcatgccatgggtgtggccaaaaaattttttttgaaaaaggaaatggccaaagttggtctctccagctctctgaccagcagctgacaatctctgttctgattggcataaccatcccctaaatacatccgtcatgttatagtgaaacagttcaggattagatccactctgtttccttaaagggccttcactgctctgttctggccaccacatacctgcgcctgtgtggtcctggaggtgcaagtttttttggaggggtgcacacaccaggctttcttccctgtgggatggggtggcactgctccttggcaagccgccttccaaggcagcttgaagtcaggcaagaagagagaagaatacagttattcttgctaaaataaatcacaccccttaatgtacacaagagatgggaaagagggcagaggaattctccccaagcacatgtttactcttcagctatgtgattacagatgtctggatcaagtcctcagacacatcttttcaagcgccacccccccacccatctaagggtgatattgggaccaactcttcctctgtactcctgtcacatgtgtaaccgtccaacgccacccctcgtcttcagtcacccttttcagagctggtttgcttcttcacgactttggaactgctctcatttagaagcagcaccagcttgccgaggtacccgtggcacagctgagctggcagccaagtggagggcccccatctgcagctgtctctcatgaggaccagctgtcctgggccgaatgtccctaaccatcctgtgcccccctggcagcagtggctcagctaatgtggagcctcctgggatgaggggcatgtcccacaacagcagctcctaccggaggccagagttcctcaccagggggtggctggaggcgcaggcaccacacctatgctcttcactcctcattcttggcccacagccaaggagaggggtggacagagatgtcctgccctgttacccctggtggctttgctctcagacacactcttgtctctatgccctctgctctgccagccgttcatgctccacttggaaagcttcatgtttattatcctttcccagtctttcctggtccctggcaggtagtggctttgagccccaccttcagtgcgacattgatgtgcccattcattggggatctacacgcaccaggctttgtaccaagtgctggagacacaacgtatgcctccacggcaggacatgaactcactgggctatagacacctccctgtgctctggtgaggccccatttccagcccatgtctgataggtggcagtctgtatttcacgaggaatcctttgcaaggagttgttcttatccttagacaaatgcccaaagagggaacgtgagatggtgttggtctaaaagactttcttaaggagtttggggcagagtagaactctacgtaagattttctgtcctactcgggtatgtatgtaataaaaccagggagctggtctacagaatgggcgatgaagccagttttacggttccctttatggcactggtctccctgggagagagtttgcacagccactcctgctccaggctgtttaatatgcagggaggccgtggtagctgctcttcttcccatcacctaccctgtggcctcccccgatccccagggagcaagacccacctcagagaccagccaaggcacactctgcctatcctggggctggaccttcactctgtgtgatcagctgctgtagctgaatgtcttctcagcggatgtggctggaacatcacccaaggcactttatgcatcttcatggggctctatgtaaaacagtggccagtgagggttcccatcatgtcccagtgggttaagaatccagctagtatccatgaggacaagggtttgatccctggctttgctcagtggcttaaagatctggcattgccacaagcagtggtgtgggttgcaggtgcaattcggatctgatgttgctgtggctgtggctgtggcctaggtcagcagctgcagctccaattcgacccttagcctgggaacttccatatgccataggtgctgccctaaaagaaaacaaaaaaatgcagtggccagtgtagccccttcttcagcatgagagtgtccaagtgagtttctggatcctgcaggttgtgtctggcagctctaagtaaggcacagagcctccgtgtagctgtgcactggaatcacccaggagtatggaaaagcctgatgcccaggctccatccaaaacaaattccaccaggttctatatgggtggtacctggaactccctgagtgcttatgtgagtgatcagtttagcaaaactgaggactaactgctgtaaggaaaggagaaaggatgacggcaaagcaggatgagaggaaagagggggatcaagaagagaagaaatgaagggctacccggagagagccggaccctaacctactggtgtctggtgctccccatgaaagggccacgtgccagcccagctcccaggaggggaatgtgaggcactgaggcagcactggagtccggttgtgatctgtgtaccagctgtgtgtccctggacataggtgtcacttgaccctccctgagtttccggttctctgatcctccctgtgggtctgtggggtgggtttgatggaaggaccgtaaggttggcacgtgtcaggcattctgcaaagtgatagcttcataataataagcattagaagaaattgctatttctagtccaacaaaaatttgccaactcttctccttagttatttctctctgctggcagacagttacttctccctgaaaggcagcagttctgaaatattcgtttaggacagctaacacaaaggacagaggcccgaggttaacaaaaggaccctagcatctgtaatttcaccaacctctggggtgattctgatacagccaaagctggggagcctctctgtaggtatccaggtcttcgctttatggggacagggcagggtcgagtggaggtgccacaccttgatgctctggcacaaacttcaccaccttctacttctttgctttccctcctacttacccgaactttccaatgattttggtgaacttctgccccactgcagcatcaaagagggccagcaagcgcacggcagggtaattttggccaggttccacctttcatttacaagtcaaaacgagacagactcgaaacccagcatcctccgaattagtaacccctggccaaacaaggcagaagccctttctattctgactgcagaggtaagactgagctgtctctccccctttttgtacttgacttccctgcaagcatctcatttggcgccttcgatcagctacgggagtgcaaagtgaaacaaagcaccctctcagcattaatatttatttttaaaggcatgagaagccccttggaccacagtgaatcaaaaggtctgtgccctgaccagtttccatgggcgtcgtgagaatgttggtctgtgggagcccgcaaggaccctcagtggatttattgcttattgtttttgttgtaactataataggaaaaaggatgtgtctgcccctgggagcagctactgtggggccctgctccaaaggcctgggagccggagggctgtggagcaggggtgatggagccctgtaacttgctaggggtctgcggaggatggatgggagagcattgcctctgcagcatcgtccctgccacttctctgaggcagagttgtcactaggagcagcctggctgctcagcgggctggtagcagagcattcacgtggccctggtcagcctgggaaagtggaaaacgccatggagactaagcccaatggggtggacaggcagccgcctccgccccctctcccgggcagtaaatgctgcccccaagccgctgtctcacaagagagccagccaggggtcattttccatttcatgaaggaggagaagggattcctgctgcagtttttgcctaaggacaagaattcctagcaacaccaagggcttctgctttatggcggaattttcctctctttcttccccgctcctcgagatttggcaagggtgctggtgttcaaaaagcaactttatacatgaaatttatcttcctgctactaaaactcatttttcataacctatcagggattaatgaaatatctgctaggaatctttacaggaattggaagagagaattttggagaagagggaaagaaggagggaatgtttcagaaatgtaaaagtcatgattaaaaaatcatgtcaaaaacggtgcttaattggagttcctgtcatggctcagcagttaatgagcccgactagtatccacgtggacgtgggttttgatccctggcctccctcagtgggttaaggatccggcattgccgtgagctgtggtgtaggtcgcaggtgtagctcgaatcaggctgtgttgtagtctggcagctacagctccgatttgacctctagcctgagaatcttcatatgccgtgggtgtggccctaaaaagacagaaaaaaaatggtgcttaattgatagatagcataggttgccctatgcttatttaacggagaccctggagttctttcatgaatgaagggggtattcaacattcaccagaacatctttttgatacgtgtcaaaatacagatatcccatggggtgagaaaacagaaagctaaatgaatgaacaatcagaaaaatggcacaacaataatgatattccgtatctattagcaccgactatgtgtgaggttccattcaaagcacggcacatcttcataaacactcgtttcatctccgtaagaacccttacctgtaaattagatgctattattatcctcttagaaaggaggatgagccaatttgataaacagctcttgacttgagcagtcaaggactatctcttcaatgtcagtatccatcccaaggccaatggatggatattcagacctgggaacaatcaggccccttgatgagattctttcttcctaaggtggagttgggggccctccctcccacaacccaatatgtggctcactgggaatcagagccatgagatttgaacttccccagcatcactcatctttcgtcatctttacaaatggcaccagaagggagactgtggaggggcgcttatagagagccagcatgggctcttccaaagatttggaaccagatgaaagactcgggggttctggagggatccagggctgccttcttgaaagctggggtgtcctgcgtgtctgagaatctggcaagggcaccaaagcaggcagctgtcttagagcctatttcaaactctctagtcttctctgtgcatgccttgaaaaaccgctatgctttttcttttccccaacggcagtaactgctgagcacctccctggctctcaggaagtgttcattggttggtggaccattcattctcgcttccattgcagaatctttgtgtgtcaagtccaggaaagtgggtttaaacagtgggtctcctggcacccatgctgtgcttcaggaaacctgttccgagattctcaagcaggctcaagcatggaagtagagaacaagccagaatatccatgctgttttattttattattatttttaaatcacgagtttgtgcttttccgtttgttttgagtcaagtcccacgacttttgtgatccccaaatctttcacaaatttattcataactggctccccctccccaaaaccctttcccgtccccccctgggaaactgccctttaaatttgccatggcaggcagtgacaatttcacaacaaagcagggagttgggtgggtgggtggggagagttttgttttctgctcccattaagagagcaactgttccctctttgtcccatggggcccgctcttggcagcagactggggagaccttgaatttggtgtcgcaacatccatacagacccgggtgagtctgggctcctcgaaggtgaattgcagctgtttggataaaattctaaaatcttgtttgtgcgatttttcggcccttgttttacaatcgctcttcttggcagagaaaccaggaagttttactttcccaggatcgcaggcaggtaattgtttttcccaaactgcgtgttaatctcggatggaaatggacattcttccccctgagaacctttgcccgtgtctataaaccgtctgtattctccctgtactttggattcaatcctgagactggatcacagcccttccctcgcttctctagattcacttctatctctggttgtaatttagggccatttacatttctgaacaacagttatgggctttttagtctcctagaatcttagagtgctttcctgttaagtggctggccttgaccaggcagcctgtgatctccagagttaagaattggcaaaatcggagttgccatcgtggttcagtggttaacgaatccgactaggaaccatgaggttgcgggttcgatccctggccttgctctgtgggttaaggatcccgcattgccgtgagctgtggtgtaggttgcagatgtggctcggatcccacattgctgtggctctggcgtaggccagtggctacagctccaatttgacccctagcctgggaacctccatatgccatgggagcagcccaagaaatggcaaaaagacaaaaagacaaaaaaaaaaaaaaaaaaagaattggcaaaatccacttctcgatgccattaagtagcatatctgagattggctggtcgtctaagccaccaccaagcaactccagggccccggtctcctgtgggtttatcatgaggcccctgtctcaagggacacaacccaggaagaggaccccacaggccccaattctgctccagcattaggactctgagcttgagaaagtagctgatgaccaaacaccattgagaggggcgtaggtcctgtgtggctgtgtggcaggcttgacagggctgctctttggagggaggtggggaggtgtgttccttttcctcccttgtcacttcaccagccctttccaggggaagtgtcaccctgcaggcgaggaagctggaaagcttgactctcagacactaactgggaccctgttcctccagcccttctgagaccccatcgcagcttctccccccagcacttgggctgtgtccagagggtcactaaaaacaggaaaatcaatacacgtgaagggaaagtccaacttgccagaatgcctttattattcatcaacaaacatccatccatccagtctgaggctaggtcctcactggataggtcctcatccagtttagaacagagtgaagattccaggccaaggccaccttctacagacgctagggggaggtgggtggtgagaggcacagccaggaggacctcttgggtgacaggaactggcctgtggtctcctgaggtgggccgtttaggaaagagtgagaaagagggaaggccttcgaggctgaggggacagcatgacgggggaggttcagggtgggtgctcagagcaactgcaggggaccctctggcctatcaccacaaagggaacctgtgcctggagtcaggccccaggttaggtgttggccttttaagtgtgccgtgtgcccttcttcatgttgtagtgaggaggtgagtgagatgagataggcaaaggtgtggatgaatgctaactcttcacctgcccttaggaaaggcttgtttggtacattctgagggagatcccaggaatggactaaagtctgagtattaccgccctttcacttacccgcacacctactattcactcactcactcttcctctcaccattcactaactcattcattcattgttttatttactcattcactcacttgcttacttgtgcagtcaacaaacattccttgagcaagcacttcctatgcaccagacactgctaggcaggccaacttcctatcacaagccaaaagcaggaaggttttagaaccctggtctccagatgcctgaccacccacatcggcctcctaggcccccctccatgcactcagtgggtcccgagcgccaggaaggtgtggagagaggatgagaggcagacccatttctccagccaggtctcatcattgtggaaaatactgattagtctgcaagtgattttatcaccagtgttctcagaacactggttttccattccctccgctgctccctctcctcataaagtaaggtcccttcagtggagcatgcagagtgctgacaggcacaaactgtgtggctcacccggagaagtgcacagccagacagcagtggaagtagtttgagcttagatcgtttctgaaatttatctttgcttgaaaataccttctaccattttcacctattttcccagcatcccagggccactgcattccctttatcccaagtcagatccctggtgtgagagttcccttgtctcaggcttcgaggagtccaatgaggcatgtgctacccacccagcccctggtcactctgttctgagaggtacaggccccatgcaaagttcaagaatagaggtcccttgtcctgcagggtctaaacacgtgtctaaatagatcacctcctgagtggttccagtatcttttctgtcccttgtggcatgggctccaggcaaccttgtctccatgagaccatttttggtcatctctgtcatggggggaggagagagcggaggtcagaaaatccaaatttgaatctaatctctaccatcaaccggctgactggtccaggtcgccacttaatgtctcagagcttgagtttcctcacctttgagtttcctcttaaacccattggtaaaataggtttagcactaatacgggacctcagatgaactagccagggctggaatttatctgggagttccctgcacagctgtgccagttgtttacacccagctagtctgttgtgattggctagggtgcacaccatgctggttgttaattattttgaatatgactccctgaagccataggcttcctaataaagggttctattatctaaggaaggaaaccctgggtcttatgtccttttctatgctaaaattcttactacatttttcttacttaaaaggaaactctgtcaaatttgactattgtcaaaactctataataaatatttatgattactaccttctaaggtttctaagctcaggaatatatcaagtgattaaaagtctgatataaagaaagtttttatataattattatagtccagagtatcatggttcgatatataacaactgggagaattttatatggacatatatccatttatttctaaacaactcaatatgagggatagtttttcatttctcacttgtacagggtggagatgtacttttttcctttcaatttgtttttccatgtctatttggaggaaccaaaataggaaaaccactacacaggtcctaaaattcacttcctctatccgttttctgtactctgctccaggtctgatgaatataactttctaaacatgtcatttatttttatttttattttttttagtctaaaagtcctgtttagaaacaccaaggggaaatatttttagcttaactaagaaaacaaacatgtttaaacaaacaacatccaaaatgctcaggtagagttggtgttttgggcgtttgcgtattttaacagtgagcctgtaagatataccctggaacagaatttttcttcctcttagatgtgttaatttcttccaggagaaagacaaagagaacaattgatcccaacttttatactggaggaaacttttcattgtttgaaaggtagtttcaagctagacaatatgctgccctcccccaacccccagtttttaattgctatttgtaggcatcctgtgcagagccagtggaaatgccagtaatggtgcaaataaagaaaaagatgagctagaataagaatgaatgctgagttggaccccattcgtgcaccataaagattgacttttctgccttcgtgacctcataggaaacttttaaaatgttcaggtagaattggtggcttagagctcaatacttcccattttgatccctcctctaaggacctgatccttggctccatgcagatccaaagcgggaaaatgatcatcttgtgattaaaaagcaaaatccatctcaccagctcttcagggcccagcaggcccagcatctttaatatcagattgttcctgctccatagacagatgagtagggactaataatattgaatgagtcaataatgttaactgagtgagtaaatgaaaggaaggagttccaattgtgatgcagcggaaacgaatccaactaggaaccatgaagttgcgggtttgatccctggcctcacttagtgggttaaggacccagtgttgccatgagctgtggtgtaggtcgcagaagcggctcgaatctggtgttgctgtggctctggcgtaggctggcggctacagctctgattggacccttagcctgggaaccttcatgagccgcaggtacagccctaaaaagacaaaaataaataaataaataaataaaagaatgaataaagtaattacccggtaaggtgctccatccatctttagaactttagattgtatctgttcattgggtttttaattacatagaccaggagtaagcccagcactttgtattttgggggtcaatggaaaaaaaaaatctgtgccttggatgtgtagttagcccaacttgaggtcagagttgaaatctctgctctattcattatacactttatctctatctcctagaacttgaagcatgtttatcacatatatttgacttactttattccaaaaggctctccagtttcattttacctgttgcattgtgtagctcttttgtgaatgcacttaactaaactggtacaataatcaatgacattatcaaactgttagtggttgtcagtaatgtcccttctcatctcaggattataagtgcttttctcttgcgagcctgctgaaccctgttgggcccccagttgctaagcattttcattacactttatctaaatttatcaggatcgcctaaccaccctaactggggcagtgaatccaactcattcacaccatattggagagttgcaagatggacactatgaaatgtatcagtgggctttttaaatccttgcacttcctaaaaggttaaaaggccagttctttgaaattaaagattttttttttttttaacccattaggccgacacgggggactaaaacttgaaatgtatgcatcaaactattggcagagtgatatatccacatcacacatggctatgaatatgtagtcaaaacatggattttagactcgtacaaaagagttcactctgaattcagagtagaagaaaatgtcaattataacaatgagaaaatcttacagaaactcagtttataagcgtgtattaacattatgtcataggaaagttaactcttctctagtcttctccaaaaaagcctatttaccgagaatacctaatgaaatggttgtcttcttagactgagtttttgggagaaggcacctaattggtataattctctttgtaccgatgcccagctaactgccagcagcaacacagtgatcttcagtgacaagcctgattgatttcatactcccttttcacattatcataggcacctgtgtttccatatgtgcaaaatagaggtacaagtgaatgaaggtttcagagggtgcaggcagcccaagatttgaagcctcaagtgtaaagcggggatacaaggggagacttggaaaaggacaagaaagcagggaaaagtactccagaaatgagacccacctactggtgatgcgtcaggcttcgactctgcatctcaccatgtggatcccccctgacctgggcctggaagctggcctcttctccccaaaacaccagagaggaagcaaaatgtggtgccacagagctctgcaaggataagtcaagatcaaaagcaccagatcaaaagagaagcagagcccagccacccagggtattttcttaaattaaagaatagttgacttaccatattgcaccaatatctgctatacagcaaaatgactcagtcatatatatatatatatatatatatatatacatttttttatattactttccatcatggtctatcccaggagattggatagtttgtccaggatatacattgccaacaatgtgcacttattgtgtgccaggcccttttctaagctctctgctgtattattgtatctcatttaaaatccaggttactagatgctgccctgtctgctaggtgttcattagctccatgatttattcattcctaatataatactagctaacacagagcacttaccagatgccaggcactgctctaagcatactacatttagtaactcatttaatactcaagagaacttaatgaggcaggtactgccattatccccactttacagatgaagaaactgaggcacagagatccttgagcaccttgcccaagatcatgcagtcgtaagtggctgagacaggattaacctgggtttaattcttagccaccatgtcaggcttcctcaggtgctgaccactgatgataatcacaatatggccattgattatttgactctggtggttataatcacaaagaaaacatcaaacatgtaaaagaatataagcagatcacttctgctgtccctcaaagaccaaattttaaatagggttaaagttattttgttaaggtccattggtgttgatccctaaaaagaaaagcaactctttgcatttaattgagaaaataggcctagttgcttttgatgactccatagaagcaccccatggaatcagggaacgaacatcaccagacattcttgggtgcctatgttgcttgaaaatctatgaagctcttgtcaaacgttaagaatcaggagtggaattcccatcgtggctcagcaataatgaacccaactagtatccatgaggacacaggttcaatccctggcctcactcagtaggttaaatatccaatattgctgtggctgtggtgtaagccagcagctgcagctccgatttgacccctagcctgagaacttccatatgccacaggtttggccctaaaaagacaaaaaaaaaaaaaaaaggaattaggagctggagcttctccacaacagtacactagagcctcagaatcagacttattgattcagtgctattagggcaataaacagctcttatcaaagacaaataagataaaggctcaagacgagagttcccactgtggcacaatgggatcagtggtgttttgggagcactgggacgcaggttcaatccccagcttggctcagagggttaaggatctggcgttgccgcaggtgcggctgaggttgcaactatggctcagatttgatcgctggcctgggaactccagatgcctcagggtgaccaaaaaagaaagaaagaaaaaaagaaaaactcaggatgcctgaggctgccaatgtgtaggacacaatgtttatgttcagctgttgagggtgcccagcccctttggtttggattccagtatagaaagtgcagtaatcactggtggacaatgcttctggataccatcctcagatttcctttcctctccccagggacatgcagactacctaaaaagccctgacattccaggacaactttatacttaacagaagaagagggaacctttggaaatttatgctacagagaccaaattaatttaccagtgaaaggagcagtctccatgtccttccaactggaaacagatcagaagctttaaggcattagaaaatgtaagctgcataacgaaattctgagtccaagcatctcatggattttgggctcttgatgtcagcaatgaatgattgtaacccaggtgtgactcgcagtgcagccttggcaggctttattagaacggcagccagctgcaacagtgacttctgagaatatggaaacagaccctccagggctgccatttctcacctcagcttttggcctgggcatccagtcacaatactgaaagggtagcagcggctcagggtccaaggacactcaggggctcttggcagccaaggacacaaggatccctaaaaagtcctctagttgttcccactgcctttgggcaggaccacctaacctttcggacagataagaagactcctggttttaagacctccacgaagggattgcaagccccatttgttaactttcactttatcaaaatgatatttggtaactaggctgtccctacagcaaggacaggaacctatcttagaaagttatgtgatttaaaatgttttagatggatggatggatagatggtgggtggagagagagagaggtaggtaaatagatgatggaggaaggatgggatagggagagagagaaaaagaaagagtgagaagaggtgactgaaagaaagacagctaactccctagcaatgagacatatgaaaaatatttatgatggaattataagctggagagtccactaagacccgttcaaaacaaatgctaccttccgtcatgctcctctagcatttcccacatacctctattatagcaccttatcttgttgcaacattagaatttggatgctgttgatctccctggctggagtgtgggctccataagtcaggaatcctatcttattcttctctgtagtctcaggatgtagccaatgcctagcaccataattctgttgtatggtctcagacagtgagagctcatgtgactaagagtaagctatcctctggaccagtgactattaaagcaccttatacagatgtcctcagcagtggagttgtgtctgcatttccatccttgagtatgttctgtttcctctgacactcggcccttgacacaggatgacggacaaaaagcgtaggagtgaaaggaccagctccaagtgccatcttgggaagtcgagggaaggatcagctggcaatccaggttggctgagaagtcctgtgacctggtcaagggtgtcatcaggatctccggagcctggaaggaagaaccatgaagggaagtggagggaatggggctagaggcatggatgactaggagggggttctaggagaacaggaagtgacatgtgatggtagggatatcattgtgactccatatgcccaagatcacgtcccagagccagtcaaggatacatatatataatccttgccccccccacccccccgggctcctggcagccaattcacctggagtgactccccatccttctccccaatccaaaccctctcatctttcaaggtacaatctgaggtttatttggccaagtgtctcctcctccacagaacacccttctccttctcttggctccctctctctcctcctcggcacattttgatgtccccctgttccagcagctctctctttggcgttgtactctgcagtctgtgaagccaggagcagtttctcacgcggaggggccaggctttatgtcttgtgggcatgcaaccctgcgcaaaaatgatattggattaagcctcatgctttaacaaaaaggcaacgggcttgctctgaggtagacagcaaagcttggaagggaatctggcacaagaactctgcccacttggagcactggtttttgacaggaactggtacaattagacccttcctgggagtcatctctgtgtttttaaccttgtcgtagagtttgtttgttagttgcactttcccttgggctgaggtctttggcattccttcactagatccaaaggcccttgaggacagtcttacctaaaccttcttacctttttccccctctgtacctgggctcccggtgttcggtaaatatttatcaagcaggtgaatgtgaaatacccgagctgatgccttcactcaagaagtaaattcttcccgtggcttcttttcaggttgtgcagattgacaaggacaagagagatttaggatcagaacgacctcccagcattactgactggcgtaaactgagccactgagctggccagtggaggcaggggtagcatgtggtcaaggatgtggttgaagggataaacacagacgatgcctgtgggctagccaggcctgagagatctgagtcttagggcctgggagatggggacaaaactgttccaaaacaatgaaggcaagagttcccctagtggctcagcagtaacgaacccaactagtatccattaggacgtgagttcaatccctggcctcgatcaatgggttaaggatccagcattgccctgagctgtggtacaggtcgcagacggggctcagatcccatgttgctgtggctgtggtacaggcctgtggctatagctctgattcaacacctagcctgagaactgacatatgctgagggtgtggctctaaaaaaaaaaaaaaaaaaagcaaaaaataaaaataaattaaaaaaaaaaaaagcagtgaagacagagccagagacataaaaagtgacagtggcaggtccagggcaagggaaagagacacagacagacagggttataaagaatatgttaacccaagtgaggacacttctcccagggctgagcagtcccgtctcctcccctggggtgtaaattcctcatgggcaggggttacattttgttcatcgtgggctgctcaggaccttgcggggctggcagggggcctggcacacagtaggcttccaagaatgacttttaacctgaactgaattgataaaagagggtttcacagcctgtcttgaccacatatccaagggccaccaaggtttccgtcaccttggacatgttgaagttctttccttaaagtctaactgtgttttttcgacacagcttaaatccacttcctctcaaaaggcttaaaacgcatgggatgattttccagccattcgggaagaaggaatcctgtgtataaagcctggattcaataaaaccagatttttaaaaaatagctcttagcatcttcttctacagacactggtctgggcaaggctttttattttattgaatccagctgaatagcttgacgacattaataatggggcttcatttctaaccactggctcacaatcttttcccctaaaagccttatggtacttaagcaactgctaatacataaataattgctggtggcatcatttcctgccatgatttgaccaccaggatgaggtttttcttcttgtacctaatctgacattctcaagcatgccatgggtgggcctgtacgatcgtacttaaaatacagtaaacagatctcactgcagctatgatttgggctgtatggagtttctttatgttgacaaattatggatttgggaagattctgttgcgtgtatagtaacattcattggtctaaaggggattctacctcaaggctgcccagaggtttggacccaatatttctgctgagcatggtccgtgccactctgtggggtcctcaggacggactggaagattttatttccttcaccttaaagatgctctttatttagcttccacaccatcatactgctttttgaagtttctctgaaaagtgactttttaaccatcagctctctttgtcttgggcttgagtgaggatcgtttttagtgtacctaactgggacgagatgtccttgtggaagaggggtccctaaaaacacacagctgttaacaggaatatagtataatacctaagagcacagcctggagctgcatgacctgagcttgatcccagcactttctgaccacgtgtctttggacaagttacctgttctgccgcagtctcctcctgtcggaaatggagataataacagtgccaacttcatacagtataaggcccagatgaactgctgtttgataaatgcttagatccatgctcaaatgacatgctgtggaagtgcctgctgttgtctaggtttgtccttttgttgcatgttcagtgcatgtattcctctccacatagcctctaagtacgaatgaatagtaaggtttatctctcagctgacatgcagtcacattgagtagcgggctaaaaaataggtaaggtaagactttgcatactacattttggggcaaacataaaatatttcttttacctgggaggttcgagtctcccattgctatggggagaaatacgtgagtccccctgcggccaccccccaaagaatttgcagtcaaactggagacacgctttttttttttttttgaagtttccctgaaaagtgacttttaaccatcagttctccttaccttgggcttgagtgaggatcgtttttagtatacctaactgggacaaaatgcccttgtagaagatgggtccctaaaaacacagagctgctaataggaatatagtatattattatacatatcttgtatcaaggagcaaaatgaaactggagaacagaccaaatgaagtctggaaggagatctggaggcgcagatgctgagacagcttgcaaatagtcaggtcaagcttcatggaaggttttcagatgggatgagctgagtcttaagatgatgggtgatggaagtaacgaggcaccggaggggtggagcactggagggtgctaaagggtgctggggtgtccggagggaatgcctgaagccctggggtgggggtgattctctcactgcaggggcaaggaagacacccccaggatgtggccagggagaaatggcacagttaacagtgacaaaaaataaagcgagagagcccagacttcacacagacttcacacacagagtgtttagatttggtttaatagaaaaaaggaagtgagagggaggtaggaaacactatctggcgcacttggcagctgtgtcacccgacgacgtccctcctgcagccgtagggtccccgagccgggcctcgcatatcctccagtgacggaggggtgcagaccggctgcagaaattaaaacactttaatatatgcgagttgtccggtccaatcacagcagatgccaggaatgtttttctgctttcaaaatgaagtgcaggttgtttggaggtggtgagggcgtgatcccatctcctctgggtctgaatctctatgtcacaggatgagacagaactcagacctgtgtctgtttggatgcatcctcagcgcactaggtttttaggggcttttctcataatttcttcatccgaagaggtcgattagcttgttctcctgtctctttcctcctccggtcttttatgttctcctgttggatggcagccttcatttcctccggatgggcccattccaggctggggtaaggagaaggcagtctccagggcggctcatctgtgtcatcacccggtccctgtgaagtggagggaaataaacagcacgtgggagggggggaaatctgtgttctaagaactgctttggtttacacatctatagatacactcaaccggccctgcgggtcacatggaccagctgctggagctgagcatgagtcacttttaaattagtcatagaaaaagaaatatgtttctaaaagccagcaccgttggcttacacatgcagccggggagtgagcaggcagcctataaagcactcaggcctcccgtgacgactggcgtgcatggtgcactgggtggggggaatgggtccaggtctgggagctctctgccatccttgtatttggaggtgagaatcctcatcagtgggaacctctgccctggagcagtgggtgctggggtttgattttccatttagcccctctttctcttacagctttgctttgtaattggcacaggaactcttaaggtcttcaataacacagtctagcagtgggtaccagaccctctgagcctgaaataggggagaagaatgtctgttcagcaaaaggtcaggaagggaggggccgaggaaagggggtccaggagcatcgtagagtacatgaacttcagccgagccttgaagggcttagtttgtggtgaagaagaaggaattccatcccaagcaaaatggaaaaaaccatctgagcaaaaagaaagcttaaatgacaaaggccgcacctttgttttatccgtggggagtctaaacttttcacacacacacacacacacacacacacacacacacacacacacacactagagagaagacaagagaacaatcaccgaggggggccgaggcactgcttactaaattggtccaaaggagggatttcaccaaatgcaaatgaacaaagaacaatatgtgtgactcaaaatatccgttatgctcttaatgtgagagggtgtgaggcagggagttgacctttgaaaggttttaaagttgtaaacttttgtaaccacattgttttgattgctggaagatttaagaaaggattacctcagggtaccatcttggaaaagtgatttttaaaaaactgcttcctacatcctctcaggggacttttttcattatgtttttgctttgacgatgtgcaattcaagtgtccatggagaggcccaaccttccacgagaagccaggagtccagaggtgccgctcctgttccactgggtctctgctcctggcccctctgccaaaattgtggttcactggagcaggggttccccccagctccacccctaaggaagctcttttggccttgttttccctcgcagccccgcccctccccctttgccagtaggtcaacatcacagcaaagtggagccgatgtccctcaccctgaatgggtaactctgggccagacattccctgaaggtctcctcggaaatttgggaaacaggaaatgtgaagaaaatgtccaatttgcgtggtcatgtgaagtcctctttcgatgttgcaatagaattttggaaaggcgtgctctgagctgtggttgaagcctcctcatcagagagcgtttgcccctttgagaatatggtcgatttgactatcccgcctcaacttccctctttctaaacatgtaaaccctgatgcctgaagaacaaaaccagaaaagaaacccactcggtcttagttgcatggtcaagttgccagcagtgctgctgagaggggcccatgtgtttgtccctgaaaagccccttggcattgaataaaagcacccgtgcaggcgagtctgtgcaggctcacgcaccatcttcaaaccttcacaacctgtgtttgcagtggatgattgatgatgaggcttgcttcccacacatttggctctgatcatctccatgctaaaacattcagatgcaaatcattgtaaaaaccaagtggcttcaagggatctttctggaaggatggaaatgttccatatcttgataggggagtgggctccaggggtgtttgcttctgtcaagattcatcaaactgtacacaaagagcaggttcattttgttctaggtagattatacctccatggaaattttaaaaataataaaatggctcgagtttagggaaaaaaagggggacatgatgtaaaatgactctatttaaaggaatttacaaacattaagagttggccaatagaaactcagacatctatgtgggcagtcccaggctgtacgggaaatctttgcaaggtgaacagattcagcccagcttatagaaactacagctggttatgtgcatgcgtctgtgttttcatatgtggttttttttttttatcttgatgtccatttttgtttggcgtatttccctatttgattggatttttttttccttctatttcctgaatatgattctcccacagtaccgaataccccaggccctataaaaagtgaatgctcaataaatgtccactcatcccttgagatggagtgtttcccctcactctggaacattctactgaaattagccagtgcatgttggccttaaatgcatatgtaaaaatggaaagtgaaaggagaaacatccatacttgcactagttttgagagaattcccagttatccctgcttctaaaaaaaaaaaaaaaaaaaaaaatccatttcagaacttttactttggaaaaaaactatttttgccccacagaaaaataaactatgtgttcaatacttagtggtatttctttttaagtaagaaaacaggattcgtgattatgtctgaatgtgggtgaatgggggcaaaggtctcctttgctttctctctctttcttcctcttcatggcagctcagaacaggtgtggaaattcccgcaagtgtaaactgtgtcagtttacacgtttgtatacagagtttcatggtttttttttttttttttctgacaagtcagtctttttgtcatcatctcatcttgaaactagagaggaagggaatggaagagcgaattgctaatatcagagcttctggaaattccccttttatggtacatgagtctttcttaagaatagttctctttcagttgtgtttttgtgatttgggtgaaaaatctcttgtccagccctccctctggtttgcttaagcatgatcccagctctctttagagcaggagctagagatggccagagggaggataacttgattttcactccacgattgggagaaaaaagcccaattgaggtacttttttttgtttgtttgtttggactttttagggctgcatctgcagcatatggaggttcccaggctaggggtccaatcggagctgtagctgctgacctatgccagagccacagcaatgtgtgatccgagctgcatctgaaatctactccatagctcatggcaacaccagatccttaacccactgagtgagaccagggatcaaatgcaagtcctcatggatgctagtcaggttcttaacccactgagccacaacagaaattccttgagatacttttttaaaaagtagataacctgagtataaacctatattcacatcactttaaatcattaatttctccagtatcttttgtaaactgatgattctcacgtgaacgaacgagtcaccagttcctgcatggtgactggcagctctataaaaacactattggcatgttgtgtgttaatggacactaccaggtccagttacaacaacctggcttaatggaagctgaccaacctgttttcaagtcagtacaatgcaaggtgattttcaagcaaaaaaaggcctcttttcccacacacctcttctgaggatgccttcttgaaaatggcagtagactttggattctggggctagaacaggcttccatcccatatggccacagggggaagggcccccagaggaaggcagatcttgctgctcttgggaccggctggcaggctgcctgaggggctcagagggccccggcacagactgaggcctggaatgtaggagagcgtgtgacagccagtctcaatgctgggctctgagggactatgctaattagcaaaatgccgggtcactgggcggccaggtaaacagtatcaggttgtttctgcgttggcagagtggggcagtgctcagagcctccgctgagaagctgctcttggcagttacttattaattgcacctagaggcaccgttggtttagacaagggagatactcctccaggcagtctcggcctttctcactctcccagcatctttgcagtccactcctgcagcgtgggaaccaggagggccttccccccagggcactggtctgaggacagctagcctcccaggcctctgggggccatggccccttcccacctctgtcacaggaacactagtctctaggccaggtgagtgaagacccagtgggagcttttcttatgaaatatcttgacttctgagtttctttttcctgctacgttgagccccgtgtatgtttgttttctttctaattttggctttaaaaaaaaaaagaaagaaaaaagaatgtttgggtacagtgtaaaagttttctcatatccagactggaaactccctggtcaccctgaaaccaggcaggtgtctgtttgtctctctgtcaataaacagtgtgtacttggcctggaaacccaccccggtagtcatggtgggcctggcccatctctgtgtttgaggaggttcgagccacccccacatgacatgggagcagggcctgcctgctgctgctcttcttttttttttttttttttttttttttttttttgatcttctgatagagaccacatagtgttcccttcatggtattttgatgacatatgacgtataaacacaggtgtgacctttacgcagtgcatggggttataattataataagtgaaagaaaataaagccaactggagttcaaggttaaagtcagaaagagctaatactaattttcactgaaaatggtgtcttggagcaacaggtagctcccccttccccggagactctgttcagttgcctcttgtgtcattttatgaagtaaccccaggcgaagggtttccatgagataagccatctcgtgagatacagacataccggtgacactctgagggcccccggtctgctctcctggtaccgtgttggatggagggcagtgttggagcttctgcttaggacaaggcatcgtgagctgtctggtcccagcttccaccctggctggcattttccttctccaggatccagtttcactgcttaaaacatagagggacttggcccctaacccatcttcttgcatcttggtttttctagatagaggacacctaaccccaatcagtttcttaatttctcaggggggaaaaaaaaaaaaaaaaaaaaaaaaaacctgtcagacccatgagtaacttaattgttgatttgtacgaaagctttcttatttagctccaggatcgctgtctacaatgtgaaggagggtggcccctggcttgagttgttgctgtgcctttttctcactgagcagccagctcagaggacagaaggtggagaagaatggaagaaagagaccccgtggtttactcctccagcctggagctgcttctgggcaaacgctttgacctgcatctctggtggcccaagaaatggggaaatcggggctctgggcacagagcccattgaggttatgaagtccactggtttgcagttactgaacagaacagcagagcccctccaccaccaccaccccgcctcccgcaaaaagaattaggacttggaaagggattcccaggccttggaaagaagcctacatttctgagtgtcaggtggacatgctcaggtctgggcaaggtgggggagacccagctccgggcatttgggtagagcttactgatgttctaaggcagggcatctccgcagggctgagtttgcctcccaggggacagtggcaaggtctggagacatttttgttgtcccttctccgctggggtttctattgaacatcccacgaagccctcccagtgaagatgtatctggccccgcaagccagtgttctaagtcctgaagccccgtcttattctgtaggttgaaaccactgggctgaggtggatgggaaagtatttgcaattttccccccaagggacaatccccggctgctggagggaggctttgtgttaactcttgctcccttcgcttctttgtcccttcctgtcttctgccccctcagccttttatttttcccctcaacagacttcattcggggccaaaatggtttctggtcttacttggggaatacccttgggcaaggcaagcagtgagaacaggaactccaagaaggccaagtgcttcttaccttggtcacaccagtggtccacattggggtcctggaagaactcaggtgatgagcctgggaggtgcaaagagaacattggaggggggtgggcagaagagagagagtgtgacaagcacactagggatagaaagaaggagagggttccaggtgacccaggcaagccctcctctctttcccactgcctgcccccatttctcgtctcccccctcacctacacgcctttccctctctgcatctcagccactatcctcgtcctctctctccacgccaatagggggcagcagagagcagaatgctgaacctacaggtgacaaactcaatctctgagccatcccctctcctagactccagggagccctgcagcttccatcccagcaggttggctctctgagaccttcctcttccaccagtgtctctcctcaccgtcagagccccagaggtggctccccagctccgtgcaccacacatcccacagcaacctgactcatgaattgtgtctggcttccggactcatctgatactgactttctgtatggtttctcaacctttccaatgaggatattttgcctcttcaagttggccacccattccttgaggcagaaggtttgctctgcccctgctgtttcccccaggccccagaacagagccagtcagggtctgtgttcagttcagttctgttgatggatggagagagtgctgttatctgctccttcccacagcaccccctctgaaggatctttatatgttatctcacagcattctcactccagccattgtagccgatgtcattcccctgattttatagatgcacaaactgaggctcaaagggattagacatctctgccaagttctaaaggctctgacatagtagactcggaaatctactaaaagccacgcttctgccccagccccagacagtcctgagattcctacagtagataatgagtccatcttccatgagcaaagccctctctttatggattgagtttaaattgttttgatttcagtttatgtatgtattcatcccataaatgcttacatacttctaccccgtgccaggcactgttggaacctgggaagacacagatggatgagatacaggtgctgcccttgaggagaagaggcagatgtgtagcagagagctcaacagcaggcagagatgggcagagcaagaaaggagtgtgatggggaggtgacagggcttggccaagaaaggctttgcagatgagatggtgtttgagcagagtcctgagaggcacgaggagggtgtgtgagctgggatcagctggaggtatgaggttccaggccgatgctgccaataggacatggagtttaaggcgtggggtgagcatggggagaggtagggctggaaatgtgggttggggccagttcaccctgtggacaacaggaaaccactcagggcactggaatgagagagaaggatgcaattgctttgttgtttaagaggcaccccctcgaaggggtgccaagggcaggctgaaggtccctgtgagttgggaagatcagcagcagcgcagtggggttaagggagctgcagcactgactggaaagaggagccatccatagagaaggcagtgatggcgtgttggtgggtagggaagaagttgagatcacttgtgtctttccggctatgttgtaggctgtcaaggctgctggttgggtttttagaggcagatttggggaaagctttatgtgttccctttgggggtgtgttgggtttgaagcacctgagttatactggatatatttgattcaaagttaggattggaggctcataaaagatttatgagccatcagcctaaacgccccttagcaaggttgtcgctgaagtcagggagggcatgaggtttctactccttggggagacatgtggccatttccattaatctatgcctttgtgtggaataatagggcatcatctttgtccctaaactaaactttgtgccttaacttcagtagcccagagttggaagattcaagtatgtgatgaataagtgatttttatcctttctgtaccactaagagttcacgaatatctgcagcatctgcattcaggcttcccctttccaggggcgcacctgatttttagatgttatagtcttagggaaggctcctctccctttgacatgtcagctgcctgtctccctctggacctgccattggctttttggagtagtcagctttcatagagcattccaggtgtggagctcatggcttagtacaaggtcagatgttctttctgttgcgttgaaaatcccttcctgctgaggacagactggcctttctgtactgaggtcttggagaatggcttttatgactccaaatctcttccaggcttgtatctgattgctcaaagatatcgcgtctagtttgaattgttttttttaggaacttaccttgaccaatgacgttaggaaattagatcctcaaatcaaaaaccacaaatcctgcaaaaagaacttaccagcttcaaacttttcacactgctcttttcatatatgcatttgctgtcacctccttgaaaggaaagggaaattgagatctctgacagttaaattgaaagataagtggaagggaatcacaattactgaatgccagtccctgtgctgaatgcttcacagaagtcatttattctgatgacagctctagaactagagtttcagtttccacaaattatgaattaagacacagaggctcagagacgtggaagacctcatctaccacgtggtaggtttaaggattccagggaaaggagaacaactaactcatccagcccaccgacacagctgggaatgtgcacggtttttaggttcaagcccagatctgtctttttctacaatttgtgctctgtcttcttcatcaagctgccttctggaggggaggaaagtggaacaacagaagcagaggccaagtgaaatagtttctcaggtgacagagagtgggcaggcagcagatcttagtgcaggcaaatcagacaccaattcagaggtgacgttacatgggtatgctcacctcctatatccgctgctgaaggagccgtgctcaaatacgtggtagaaaatactgaaattgaagacatgatgaggcattatcctgactacccaccatcctgatatactggggggatcttacagcctcagctaaacccatgtgattacatattccaataaggagcctctacgctagttgatgctgcaggaggcacaccagttattatctttttgcctcctgggaatattcactttattactatatagtaagaacatttaggagtagcactctctagatgagctggttggttaggttgacaaaagcccatgcacaaatgctagaagtttaaggagaaggttcagtcaccacaatctcttctgccctcacttgatttgacagtaaaagctcaggcctttggactaactttgggggaaattttgaccaattaattttaaaaaaatccttaatttttgaatttcttgaaagaggtatgtttttaaattttcaagtagctagaattgggcacacaaagtgttgccaagaggcagctctgcttagcaaatagtgaccacatcaaaacaccaggctcggtctggtgtgttgtgttcctgcgcccataacagttacatctctttggtgtcaaatgcatgtttttaaaaatcttgaacactgttttctcttggctaaataaacaaactccttgatggctatttataactgtttgttaaggtgtctctcataagctctgcaaagtggttagagcccaaaaggtatgttttgcaggttggctgttgagtaaagaccatctgtttagatcagcgcctcagtatctcctacccaaggcccctgcttaaagttctgaactagtatttctcggcttgtcaaagctaagctgccagcttttgtggatgatactgactgtcttcctcctgggtaggagcctggcctcgcaaattcgcccgtgagcccatttcaccctgttttctagctcatttaccccagggctccctgcaacctctgaaaaccttcatatcacagagagccagtgtttgaggggcatttggtttcaacttgcttgtgtttgaacgtttatatttataatcgtgctaatctctaaggcactcaaatcacgttaagagctttgtccaaggctgccaaggaaattagcatgtatccacatgactgggaaggatgagaaagtgggtagggcctacagaaaggtaagaggctctgatgttcctttcagtaatcttttccatgggattttgtttggaaagccatgcagccaggccatccccctgtctacctctccccctcctcctccccctccccctccagctgtgctcttactctcagcccagcccctctctcgctatgggccaccctgatggtccttctccgaaccctgctgtgtctgtgccacaccttctgccacttagggccttccttcttatatcgccccctcctggcttcccacatatttgtctccaaccaaagggagaggaacaggtgtgattctctcttgggtcccccccagaactgaggttgtgctgtcacagagttgatgccccgtaaataatgcaggatggatggttagtcaggtgggggtgggaatgggtatggtgggtgggagggaagacacagggggaaggagcttagattacagcagacagtgtaggtgtggggaagggaattttggggggaagtctgaacagattaatttgacccatctattaggctaatttagagaagagtacaagagggaaaattccctttgagcaattagagaggcgaaagagaagcagggaatgtccctgattgcattacagaggaggaaaccaagacgacttcttctcaagtcctttgctgaagccaccatgagagctcagtgcagtcaggatgaaagaggcccatttgccttctcgggggagacatggctttggattctttgaagagcagtgttgcctgtcaaattagagggttatgacaggagccgccaagtggaggttggagaattcatctccattctcgcaacccggataactcctaccttagcagcagattttatgttgccctccaatgtaaaatctagaacttttactgccggaagttctccaatacgtgttcactaggcttcagcgtttttaggaatcccacctaaatctatgtctttatctccatgtggagatggttggtgtatcagactaaagcagctcactagaaggctgaacagagtctggttctagaatttgtgcctagcgccgggggttcaggaaaggctcggtaacgatggtttcacagcatagggaaactgtgtcttgagagaagattgatgggagcaaggacaaatgctaggagaaagcgaaaggatggcaaattaagagggatgaaaagaaatggcacattaaggtgggaaattaagaggaagggaaaaaagagtagatatacatagcaataaaagaagaaaaatcattgtgatgcatgatggatagagaagtgactttcctgtttttctctgggccctaatggacccaccactactgatcgaaggtaagagcagactgttttctgtgagatccactcttaacgaagaagagaccccttagcagtctttctcagacctccatttctttcattttcaggctgactcaagcaaagtggggaaaaaatcgcatctggacaaaggaagcttatctccccgaatctcaaaacctatgtcaagagaacctttactgaagagagccatagagttaaacactgtacttaattccaaccaaaaactagataaagggttagaaatcagtgttattagtggcctctccttccttccttaactgctaaccctcagccaggccactataataacagtgttatttttcatgcctgaaacgaaaatcagagattccatcaagaaagggcttttaaagggaggctgtgttattgcagtattatttggactctcactctaaatatacaaatgattccaatttctcttaatatgggttgagggtggcggaatttaagtctcactgggttaaaatagcaactcaaaaacacacgtcaaaacccctaatgtcagccaacatttatgatataaatgagcttaggtttttttctctcataattttaactttttcaaagagatggagcttttataaataagcaagcatggccatattcagcctacgacatcttggctctgtgcaagcccatttagctgggagtcgtaacttcatttcagggaagatgtgtgagagggtggacaggcgagaagttttatgtcagaattctgggtttgagtcctggttccatcattgattaaccacgtgtccttggaagagttaggtaactcttggttaattcttggtcatcaggaatgtgggggtgacaagagtcatgacttatctatgggttgttgggaggatcgaaccaattgatagataaggaagaacttgatcaactgccctgcaaatattcattttcacttttaataggtacctttatattaaaaggaaagaggcaggatttcatcctcaatgtgcattcactctttatttaataatgcttttggtgtcctactgtgttccagccagcaaaccagcgaccagaggactgccacttcctagtgtcacattgtgatggtgtgaggtttattccttatccattgccaaatgataatttttggccctcagaaataaggagaaaagcccaaaagccagaaagataaaggattaagttactctttaaaataataaatctatctgtgtattctcttctcctttatatggtgccggtaatttttaaaattagattttcctctgggcctttcatcctaaaaatgatgaagttccctgtccctggtaattgcatttcttttgattttcttttattatgacttgcatatcactgacacttttcccctggaatgttaaaagtatacatcatccagctaaaaggggaaagaaaatactgtcttaataaaaacggcaaagagagagaaagtggagattctgctcctttggttccaaacaaggcaaagtcttcattccttgttcttcatacatgccaaggttgatgtcatggaaccaaaccagtttggagttatctgaaatagaaaaaaaaaaaaaaaaaaaaaaaaaaaaaaaaaggcagttcaacaatcgtgcggattgaaaaacaaattttctacagcatgataacctgagaataactgaatacattttctctgtaatttcttgggtcgggagtggagggtggggaggcattctgggaaagactgaaggaagagatgttcagttcaaggggtgctctgagagatcccagaagagctggaggggccagaaaggaataacacggtaaccttgattaccctatggttctactattcacagaaaagagattaaaaaaaaaaacaaaacaaaacacatggttgatgtatgaatacatcatcaaaagttaccattaatgagtgttatttatgaatgataagcaggacacatccagggaaagcggctcttattttttcacaaaaccattctcacattattgagatacatctttcattccattagaactatagtcctaatagctattgcatggcgtcctacgcaggagtggatagttggaactttgggaaccctgcctgtcagtctcatgtctagggccttgaaggtttggccattagtttctgttgtgcctagaatgtcaggtgtattcttagcggctctattaataaggccaattgctactagtttcctccagtaaaaccagctctaggattcgggcctccattgcacccagaatagatggaatggcaactctaggacttttgatgagaaacaagaaggccctagtggactgtttctcccagtctcccaatcatgtaaaccttttccttctttcttataatgcacaaacacaaagtagaatcccaagatcttcaagttaatgaaacttagaacccgaaaggaccctccgaggacaggtggggcctttctcttcctgtcaaaagtgaagcctttgaaacttggagaggtgattcctttgatggcagggagaggccctaagcctggggtagtggcagcatgatgggcttctgagccgaggcatagctctgctcagacacctgccttggaatttcttactttttcattaaaggtctgaaagactggatggcagtgagattttatatttttaattgatatggttgacataaaatgttataatcatttctggtgtccaacagtgcttcaatatatgtatattttgcaagtaaatcaccaaggaactccctggtgggtcagtgggttaaggatccagtgttgtcactgctgtggctcaggtcactactctgacgtgtgttgaatccctggtccaggatcttccgcatgctgtgggtgcagcaaaaaaacaaaaaaaaaaaaaacgccacaatgtctattaatgtatccggaattcctgccgtggcactatgtgttaatgatccagcagctgggcacagcgggttaaggatccagtgttgctgaagctgtggcatagttcgcatctccggctcagattcaatccctggcacaggaacttccatatgccagggtgcaaccaaaaaagaaaaaaaaaaaaaatacatccatcaccacacatagttatcgttttttttttttctttttctagtgatgagaacgtttaagaactactgttttaacaatgttcaaatatgcaatacagtattattagtcaccgtgctggatattatatcccaggacttattttatatctggaagtttgtagaaaaagtcttataagacatgatgcggtaaaattataatttttaacatttaaaatgacccttaataaaatgaccttttccaactgatgtaccaagtagtaaaacttacctatttgaatctgtaatcatcagtcatgatcttacacccgggatcagaaaccctccaggtacgggtggaataatcctttttttttttttttcagttttgggggttgttttagtgggttaggattacctcaaaagacatttaaatgatgtttcaggttcaaacggaaatgaagagcacataaaattgtaagacgtaagaatctcaagaatgtggcagagttgaaaatgcaccaagaaaacacgctattagaggtgtttggtctgcccatttatccaacacgaatcccttcccatcaccaccctgccagtatttaaccctgcaagggttaacagaggactgtagagccagcagctggctcagaccccagccaggatggagcacctggccctctggggctgccatggtccaatggtcgtgacacttcaccatctcctgcaagtctcaggtccactcgggcccaggaccagggttgtttcaccaggaagagggccagaggggcacacacagcccttcccatggctgcagagacctcccttgttccaagtagcccacaagcagccctctacacatcccacatccgagagggtgcgaggtcactgtctcccaggaaactcagagcaggcctgttccggacacagccagacaaagggacaccaggaacaaaaacatttggaactaagggatgaacttcagctgatacaacacgagaacaggaaagcaatgccaaagaccagggccaaggagaaaaacagaaagggaatttcgggggaaagggctctggggtagaagagaggtgtcctattggggttccgtggagtcaggcagccaggtggtgaggctcggaggatcacccaggccctgaatctcttccgaatccccccatcaacacacccagcagggtgtcaggccctctctgctctgagtgggctgagttcagagccacctcgggcacgagcaatgccgccctcacttgttcatctgtagttggatgtgttagaccccttgccctgaacatgctctctctcagctgccactcctgaaaaggttaaaaaaacaaaaacaaaaacaaaaagcccttctgtcgaagcttggcctggccggggcagtctcaaactcacccccaaaacttccaacctttcagaaacaaaccaaacattaaaggattaaacaccccggcaagaagataggttttgtaaaaagctccgtgggcaggttcctaggaattgaaaggtctctggctttgttaagttatgaaagatgtccaagttgaagtcagcagagaaaactgttactagtcatgagacagtgggtgacgtctggatcacacgtgggctctcaggccgggcctggccggggtggctgggccgccggcctcccgctctgccctgaggtgggggctgctgcggacacaatttaattcagcctggatccttgaacagggcccttgggagggtcagcaccccctcgcccgtggaggctttagagtcccctgccttaatatcctaaagaggcctcaaactggattagttttggggatgtgaggcaatgttctccttgatgtcccagaagtcctggtgaggcagccctgggagtaggagggctctttcggatactgtggaaagaattcctccttggggattcactcctccatccacacatcttttttttttttttttttttttttttttttttgtctttttagggccgcacccacagcatatagaagttcccaggctaggggtcgaataggagctacagctgctggccacagccacagccacagcaacgccagatctgagccgcatcttcgatctacaccacagctcatggcaacgccggatccttaacccactgattgaggccagggatcgaacctgtgtcctcatggatactagttggggtcattaccgctgagccataacaggaactcccacacatcatttttaaatactcctggggtgacgtgtgcaagagcagccaccagggccaaaccacaaagtgagggatgccaggaagcacgtattcccgggggagccagactgtagagccaccgggagctgccagggctagtgggggattgggatgtgtgctttctccctggtcacgggggacttcttcagtgaatgcagccctgctccctccgctcaccccgcacctgcacacacaagtctacctgcactggaggccataatcccgacctgaagcccgtgccctgaaacactggctgctcttttcctcccttatgcagagttcttcaggctcggctcctagctaacctcggcccctctagcccatctcaaagactcttaatgcatttttcaagtcctccccatcacccatcagaactttctattgaacttctcatatttactgcttgtctcctcaaagccagcatcttcttcttttctatctccagcaggagaagcaatgtgagttgaaaaagcccagacctaagagtctcatagttcaaactacagccatgccacaacaagctgtgtgatcttgagcaaattgtataacctctctgacccgtttcacctgtgtaatgttgtttataagagccacctcatgggcttggtacaatggctacttcttcttcatcccagaagtaggcatgaaataaaaaaacctggataagtggtttgactgtggttgctttctggcctcagtcatgtccaaaggagagagcaaagcaggaggaaatagggccacacttgtgaaaaggtgccatgcagtgctagccagagccatatagtgtttgcagcaattttactgtgaaaagcatgtggcacatggatccaagatttatgcatttggccgagggactacctggttggaaataatcttcgagacccagagtcccacctggaggcttcgtcagcccaaacttgaacttctccttatgaccttagggaagaacactatttgcatccaatgggacactgctgtctccgagtcatcccgctgggagagggtttgctgagtcccctctttgggtaaggaggagctgattgtattgggtgggaggagctgattgtcacacagatgccaggtcccctgcgcccctgcagtgctgagcatagtgctgggcacagagcaggtgttaggtgcaagcctgcatcttgcagttcagctgccccgttccatggcttcagcggtggcaggagatgtgaggcccaccacgtgcaggcattgacctctgacctgccagggccgcttgcaaagttctgggctggaaggaactggtggagtttggcccagggtgtggttcagagcccatcctgggcccagccagcagatgcctgcgcccttctgcaggcaggtcccgcaggctccatgctgccagcctcagacatgtctgagcatgtgatgaggggtggccggtggccttggaagacgagctccatgggcacggcctctccctctcagtgcccacagctaacgacactgacagtccttgttcagggtgtacacgtcctattcccaccttgccggtgtccacggtgggctcgcctcacttcaggagggtgacctggtgtgggatcagctgtccccctgctgtgctgatggaaaagtttcagcccctcctctcacttgaagcccatccaagatgactttcggatctctctctgtgtccctctctttctttccctgtgagtctctctccatctctctgtctctctttctctgtaactttgtctcttctctttgtgactttgtttccctctttttttgtttctgtctcctgtctctttgtctctccctgtgagtctctgtctctgcctctctctgtctgcctccttccctctgtctatctctgtccatccctggctctctctctttctctgcctctgtctctgtttgtgtataaggccctgaactgtctggccacagagagcacccactgtcacaagtcctccacagtaaacatctattaaatgagtggctacgccagcatatgtgcgtccctgcattaatgaccctaaattcagaaccacagcgctgaccttgccggggtatgcacgtccccaccctcacagctgtggccgcagaggagactctgcattttcttgtgatggagaggtctgctctcttccctggacacaggaagactgatgcggaaggaagagggttgtcaaagagccaggcagtgtgccttgaaatgcatctgtttttattcatgttgagtctttgcaggtgagctgaactaaatcataaactacaaaatgaaagcagattttccctagcactcccatatggagcccactgagctgtttgttcaccaccatggccgcccctcttccccgagcatctggggcctgcttgctcttcttttactgagaggcagacaggtctgtggggtgcgggagaggcttcccccgtgagctgctctgcttgaaggatccccttgtcattctgaccatcattcagtgacttacagggctgcagaactagggcacagggaccagggtacagcctgttatctcccagggtgcttttcaacagggtgtttgaatcctggaagttttaagcagagttttcgactcacttgctgcagactgagaatgccagaaccagcaccatggggagggggtttggggagatctggtcctggtcctgggcaggtgtctgatggctgatttttttttttttttttttttttttttgcttttagggccccgcccacagcatatggaatttaccaggctaggagtcaaatcggagctacagccactggcctacaccacagccacagcaacacgggacccaagccacgtctatgacctacaccacaactcatggcaacactggatccttaacccactgagtgaggacagggatcgaacctcagtcctcatggacactagtcaggttcattatggctgagccacaatggaactcctgatgtctgattctaacatcaaggcaagggccctggagtcagtgcagtggtggagcttcaagaaaagacacccatgatggtttcttttcttttcttttttacccacagcatatggaagttcctgggccagggattgaatctgagcttcagctgccatcaacaccacaactgtggtaatgaaggatcctttaacccactttgctgggccagggactgaacccatgcttccacagtgacccagtccactgccatcagattcttaacccactgtaccacagtgggaactcccacatgctgagttcttaaccagtcctgaaagcaagtgtcagggcaggcctggctgaagctggcgggctctgccctgctaaggatggcacccatgcaactcattcccttttgcacttttcactctgacacatctgcttcagatccaaggccactttccgaaagttcctattaggaaatgcgggtcctttgtactttgcgccaccaccaacttcagtcaacacttgctgatttaaacaagtgagaatcagacattcagcccccaactctgggcctccacatttgataaatgaaggaccccctttcaccccctgccccccagcagcggtgcctgatgacagcatttaggccaagcgcaggactcagcagcatctgctttcagttcccattcttggcatattttcatgaattaattcttgcagcaccaaagagcaggagcgggtaggtaccctggctgtgctctgcattcacaggccacatggcaggcacagcagagcactgcaggctcagtccagacagcgacccacagggggcgcacgcacctgccaccaagggcacagtgatcaggttcatgctcacttacaggcaggtctggacactggccagggggccacacttgtgagcatgggttgagaacaagtgagtccttctgttaaattccatgtggcatagttcagtccacttctttatgtagtgtaaaaagtataatttgttgttgttgttgttgttgttgctgttgttgttgttgttgctatttcttgggccgctcccgcggcatatggaggttcccaggctaggggttgaatcggagctgtagccaccggccttcgccagagccacagcaacgcgggatccgagccgcgtctgcaacctacaccacagctcacggcaacgccggatcgttaacccactgagcaagggcagggacggaacccgcaacctcatggttcctagtcggattcgttaaccactgcgccactacgggaactccaaaagtataatatttttaagaaaaattgatgtaccttaaaattcaaagtgattggtttattggtttttagtatttttattcaaatggtagtgcaaccatcactgttctctagttctagaatttttttgatcactctgaaaccaaaaaaagtcccataccctttagcagtctctttctgttctctctccccaaccccctcgaaatccctaatctacttcggtccctatacatttatctattttggacatttcatagcaatggtatcatacaatatgtgacaacttatgcctggcttctttcactcagcataatattttcaagattcatccatgttgtagttggtgtcagtgcttcatttctttctgtggctgaataatcttccattgtgtggatggtatccccttttgtttatctcttcatgagctgatagacaggtgggtcatttcccctttgggctgttacggataatgctgatgtgactatttgtgtatcagtttttgggtggacatacattttcagttaccttgggaatatatctaggagcggaattgctgggtcactcttggggttcagctctttgaggaaccaccactgttttccacagaggctgtactattttctattcccaccagcactgtgtagggtctccaatttctcttcctcctcatcaactcttgctattgtccactttttactttgtagccatgctagtgggtgtaaaatgatatctcattgtggttctgatttgcacttccctaatgactgatgaggctgtcttttcttgagtttattggccatgtgtatatcttctttgacgaaacgtctattcaaatctttgtctgttctttaattggactatttgtctttttattgttgagtcataataattgcactttttttgctcgatgtacattcttgaccaacaaaatattgtaaagtgattattccccccccccaacgatgaaaatagcccaggctcaaagcaagaaaaggccaagcgccagaaaatgcaggatgcattagccaaaagaaggtagtagaatgaggaaggtcaggaagaaaaatgaagtaactttgttttaaagccaaaacactgcaaggcagttcactgaggcctctgtgcctgtgaggtcccatagaaggcactgttcaaacaaggacagcggcattggcatcggtgcccgtgctgctccccagagccctgcagggtaaatgcatctacacacatatacatacacagtgcctggaacatgctgagagaactctcctgctgtcgaaagctgcagcaagtacacgagaggctcacaccgcagttctgacagcgcaggcctgcatagtattttagctttgaaactcctcagcaccatataaaaaatgtttggttcctgaatgaatcagcaagtcaaagatgagatttcgaggtctcgtagagatctggcctttcttctgtgttgttttggtttattgtaggaacctgatgaaccacatggcacaattatttgtttattttttttagcacattttgctgtagatgcattgctttgcaccatttccacagacgtcttttgaagttctggactgttctcgcctcctggcaggagggacctaagctacaggtggccaagtccccactccctgtagtatttgcatagctagtgcaaggactaaagatctgtcactgagcttccctcggggtcgcagcgcccaccccagcccggggggcggggggcagttagactagcagaactgcccagatcctgcctgtgctggctgcctctggctcaggtctcctccagcaggtggacaggaccagcggcctttgacctggctcagtggccacagggtccccagagcaacagacgcctttgcaaattagtttcaaactgcggaggagaaaaggaaggaaccgttggggttctcatttttctgccctcccaagctccagaggcccaccccctccccacctgatttgcatcctcagctcaatttgcatcacaaaatacacccaaacttccctggacccgctgccgtaggcgggcaagttgtgtttttttgttttgtttgggtttttcatctcctgccatttctctagcaggtttctggttacatccagatgacacttagattaggtttcactttacgtccttggcctgtgattcaactagcccctcctcctgggccagagcccctgcaagatcaagccccatccccgggccatggcttgggaggcagccctgcaggccatcctgcttctcacactcactcgcgcctcttcacgacccgtaggccctgcagctgtgtgtccttcagcgagacactccagggttggagccttttttttctttttttctctttccttttcccccaaacccggaatcaatattttgggagtaaaggtggggaagggaggggggagaaagagccacaggagacagaggttagcagtcacccaaagtggctcagttctccagacggaaccctccagactcattcagcacaaagtggctgcagaggaaatcctgccgggccaatgataaggggggaaatggagtcacttccttaccagctgctttattcaggtaggaaaaaaaagtcctcacttcctcgcgtgtgctccgctggccaccactcttggcggcccagccgcctgcttccccttttgatctctgccacggctggtgtccagagagtcactgcctcccgggcttcaggagagccctctgtgtgtgtccgccttctcccctccacttccttttttctcaatctctccacactccctcttctcccagtggttgcactgcagttgctgtgtgccgttggagaaaccctagatagtacttattgggaatgagtgtcacacccttgctggaatccaagactagtgatcactggtggtccttatgttcccatgaatgtccaggagcggctggaggcctttgatcacctctcctgccctatacaacagggcaccaccgctgcctctctggtcaatgcctaagcttattgcttttgtatctccaggcagcagtctccgtctttataacccggtaggaatctccctgacagagggataaagggcccggtgagtctgaaaaataccccacagcttatccctcccttggagactcacagggcgtatgggtgggcctgctgttcaaaatgattaaccaccaacatggcacagatgatgaccagtcagatccagcactgacggccaagaactggctgaatgtcagttcctcaccaggaagacagtagagtctgggaaaaaaaaaaaaaaaaaaaggcatggatttgtttaagccaatcatttattccctttggacagacttcttttaaaaaatatcatctattgaagttcccattgtggcacagtggattaagaatccgactgcagcagctcaggttgctgcagaggcatgggttcaattaatcctggcctggcacaggaaggttaaaggatccagtgttgcctcagctgtagcttggattcattccctagcccgggaacttccatgtactgtgggagccatcataaaattaaaaagaaaaaatcatgtatcatggtgtgtttggaagaactattttatagtaaaagaaatcagtgtatttcagttccacaaacatttgctgagtacctaataagtgagagacacatgctccaaggatccaaagacaaataaactatatggtccttgcacctccaggttctaatagataaagacagacctgtaaacagatgatcttcagataacacagtgaacagggactagctgaggattatttagctcagcccaggggctaggaaaaagctgcctgcagaacatgattgcactgaaattcctgaatgaaccaaaatggacttatgagcgacagaactgagcaggaagctaggttgaagcagggcatctggagcctaggatgtcaagagtttggacttaagcatggagataacagacttgattctgaatagatcattctggctgcaacagggagaggagattgaagggttgggcgtgagactacaggcagagagctccaatgggaaatcatagcagtgtcctgggcagggaaggtaatggggccagagacatatttaacaacataggtggtccataggctgctgtgtggaatccccttaccacttcagtgccctctagcttgacctctagctacaagagatgcagcatctggatctctttccctaagggctttctttggcctctagagcccactatgcctgtgcacatgactgcctgaaagtactgaggtatttatgctaccacagaagcaacactcagccactgaatggaaggagttggtgtatacataccccagcttcttcacttcttagtggaataacgggagatgcgtattctgtgctgggctccgggtttcccagcaggattgagttccagttgccagcagcagagacttgcttgataaggtaactcatgaccacattcccttttccgtcttacttccccactcccttctggtgtttcctgggatcaccttccacataaactgttcacactccagtctttttcttagggtctgccgctgggagaacccaacctaagactgtgggatttaccagtgagtgaattggatgggggtgaaggggagaatctctctaggagatctttgggctgtgcgcttacttgacagtatgaatacggtagaggcaggaagagaggcaggcttgctggaggggctgtgatggccccaggttggacaggctgccctgtaacttctggtgggacatctaagaaagcgattggaacaggaaccgggcagtcaggggagcaagtggggccatatgtaaaggtttcagagacgtcatcataaggatggtgcttgtgaccatgactgtgaaggagattagctgaagagagagaagacaatccagatgaaagctcaggagcatcaagtacttatcagggcaaacagacaaggtgcccatgaagggacagagaaaaaaattctccaggaggggagctcccattgtggctcagcaggttaagaacccaactagtaaccatgaggatgcaggttcaatctctggccttgctcagtgggttaaggacccagtgttgctgtggctgtggtgtaggtcagcagatgcagctccaattcaatccctagactggaaatttccatacgccaagggtaaggccttaaaaaaaaaatacacacacacacacacccctccaggaggtaaacacttaccttgatctcagtgtccagcacatcaaagcaccaatcacatatgatctgcagagcctccaggggatttagccacatggacggtattggtggtctctaggggttggtttcagaagcacagtggaggaagcagccaggccgagtggattaaagtgtgggtggaaaggccaccgatgtaggtgggtgatcagtttatcttggagggcaaggcagaggagataactttcaggatggaacccggcatcggtgtggacattctgagcaaatctgaacattcataggccaaggaaaaagacagaaggaggatgaggttgacaatatagttgtgagcagggataattgatggaggatgagtggaacaagtgtgcggtggaaaggagcggggaggacagacagagatgtgagttgatgggggcacccaggtaggaagctgcagtaattcccgcccaacagcccgatttgctcaaagaaagaggtgactgctaaacagtgcaggtaacacatgagaaaagagttgctgtttggaatcgtcatggaaagaaacagaggcgagatcccgggcaagggagtgctgagtgccgagtgctttctagaactctctgagtgtggagcccataaattgagagacggcccagtcaacatggttgggcaatctttgtcagcaacacctggaggccagaggtggcggggggtggggggagaaatggatcaaggtcagggcacagaggaagattgggatgggaggaagccagttgcaggcaaggaggaggaggggcctagggagataaaaccaagtactggctggtattctaaccccaccagcccgagaggctggagacgacagcccagccccatccctctccagctcctctaggcttattagtgtgtgccgtgagtaatttacctgtctacatttcatttctcccatctatgtaaaaaggcaatactttatttttttgcttttttatggcctcgggtgtagcatatggaagtttccaggctaggggtcaaattggagctacagcaatgccagaaccgagctgcatctgagacctacgccgtggcttgtggggacaccagatccttaacccactgagcaaggccagggatcgaatccgcttcctcatggatatagtcaggattcatttacactaagcaatagcgggaactcctgaaaagagggtgctatctttactatatggtgcaggcaatctgaacttccgtggaagtaacatccagctcagttttgcgttactatggtttgccttttttgtttttataaggttgtcacgagggaggtgatccccatggatcactgatctctgtgtgcacccccgaggcgggacagagccctcaccagtcctgacacgagcaggggctgctgtgcctcccaaatatatagattgggatttggtccgagtcacgtgatgatgtcccaggttttctttttccccctttgttgcttttaatacataaaatgagcatgtgtttatttaaaacagctttcaaacttaaacaaataatgacagactgttcaaacagacttcggaaatcaccctaatcaggatgtttggaaaagcgagaagactctccatgaaagtagcttttaggatcttcatgcctgaaaccacagggtctgttttacactttagaatcatagatggcaaactgtaaaggacagattcgatctcagggcacacctcggccctacaacgtgacttaataatttatgaggaagtagagttgagcgtgtgttattgcttccaatcttccatcaaagcacatcatgtatacattttaattcacaatttctatagaaatcaccaagggaaggaaggcggggggtgggggtgggggggaggaagagaacacggaaggaaggaaggaagagacaccttagagggagctactaaagtgcttctggaactagcaggttctgtagaccatctggagggaagggtggtttaaggagggatgtagcaggtttgcaagaggacagaacagagagtgagttaatgcctccaatagttcacactccgggccacatttacaaatggctttgagtcacctacgtttatcttcacaacaaccaattttctgggtgaaataaatgaggctcaaggaggggtaatttgttcaaggtcataagcaataaaatgtcaaagctgggatttcacacagaccacctccccccaagttcagaactagtccccagactcttgggggctgtgtcagcgtctctgtgctcattctttggattaagagatgccactttagctcatcccactttagaggtgagtttttccttccagtgcacatcagaagtgggccattaggtccattagaaacacagttatttacatgaggggccagagcttgggagagggaattagtccagcccagagagggggaggtatttggaggggtgtttcttcccactggtacgtgcatcaggcagagcagcctgagattgccctttcttcctgcacttttccagggtggctcttaggccagaaagggcagaaggccaaggccttagtctgtttcctattctgcctcagaaaactccattaataaccaaggggatacaggatccaaccactgaccctctcaatgtcaagccaaactgcataaggcccagggccagcactcctaggaatttgggcctcctttggctgggctattaggggttccagcccgcccatccctcagagagaacagcatggaggggaagggatgttagatgattgctgtatgtccgtgtgatcctgggatgcactttgtaagaggcagtttctctaagtagatcctgatcctttctgccccatttattccacttttacagagagaaggtaggtgtcttgacaaacaatcatgattattagttctgctttaagggcattaagcccatacttcatttatgtctattgccttgctttgcactaaggctcaaacttggaaaatttaagcaggttaagaaagaaagcccttgcgccctctcctggtaaagttaacccagtacatctgaaggtagagctcctgcacttgttggggagggagcagttacttgtccaggctaacttatcttgtgctgatttaaggaaaactgttggcacactagattgaccattgggtcttctatgggctgtgatcacagagtttcttctaaacctttgttcacagggtttctcagcctcagcactattgacatgttgggctagataattctttgtggtgagggcagtcctgtgcattgtcggtcactggacagcatccctggcctcgacccattagatgccagtaacatccttactccagtctgtgactaccaacaatgtttgcagggattgtcaaaggtcccctgcgggggtggggtgcaagaccatctccagtgagaactgttgacccaaacccttgcctgtcttttcaaaaaggtgccatggtcacagggagaaagcaaggatggctcagcacaaaccgtttgtgactatgggaagcaattttgatgactggtcttctgagttcacctctggaaatttgtctcaaaaaaaaaaatccaaacaagtagacaataatttacatacaaacatgtatcataatgttgtttatgatggatggcaaaaattttaaacaatccaaataaagaattggttgaataaagaacaacccagatatatgatatatcgatggaatattatgcagtcaggaaaaataattgtgtacatatatatttaacaatgtggaaagttcccttaatgataccttaaactcttacctttgagactactgcaagattctcagaagttgtggtatgtagaagggatgatttcaagcaggcagagtaagcatctgggtgaagtattaggcccaacacaaaattcaaaccaatgattggcttcagaaaactttacttgttaattgagtaaacatttattaagcacctacataccaagaccatgcataccactaggaagcaaagatgacaccttgtccctctactgcagtacttgccccaaacagacaaaacacggtgaacaccatcaggccatcctccacacagtgatgcgggaaggctctgtatttactgtctcccatactgaaatctgtactctaattccaggttttgggggtaactgggactacatctcattttcttcttcatgcctgattattcacaccaagttaaaaatattgcctttactgttttatagattcagaaatatttagagcattgtccaatgacatgggtccagacatggaacctaccccagcaactctgagaaatgggcattcaatgatctcagcttttttttttttttttcctcagaacaaagaaaatgactccataagatggctatgagaataaataaaataatgcgtgtcagatattctgagggcatatagcaagcctccagaggaatggttggggtttttaaaaattatttttatgaatggccatggtagctaaaattgcaaagcaaatatatctaactgcctttgctgttttatttttccccttagcacttaccactctctaatacactatatgatacatgtgtttttgtttactgtctatcccactccattacataaaatctttgagctttgacagtgggttaaggatccggcgtgagctgtggtgtaggtcacagatgtggctcggatccgtgttgctgtggctgtggtataggccagcagctacagctgcaatttgacccctagcctgggaacctccatatgctgcaggagcggccataaaaagacaaaaaaaaaaaaaaaaaaaaaaaaagctttgagtctatttttcatctcttggtgcctggcaggtatgtagggtctccatatttcctgaaatgagagtgaaaagagggggcctgaaatcattgcccccacagtacctttgagctttcccctcacccttctcaaggtgcctaggcactatggacgcctctctccctacaggctggcattctgtgctctaattttctttttttcccctcctctccctcccgcaggatgcctttgtggagctgtatgggcccagcatgcggcctctatttgatttctcctggctgtctctgaaggcgctgctcagtctggccctggtgggagcttgcatcaccctgggtgcctatctgggccataagtgaagtccacgggcctgccacaaacaaatatgcaaaaggttcactaaagcagtagaaatgataatgcagtgtcaatgacgtaccatgcaaagaagctgtggtctcttaaacacacacaaaaaaaccaacgaaaaaacagatttcaggctcaatgtcgaatcagctacttactgccaaagggaaatacaatttattttttacattattaagaaaaataagatttatttatttaagacagccccgtcgaacctcctgtttttggaactctaccactaattatcaagccacccctaccaccaccacctcttacagctccgcctgaatctcctgtgcctataaacacggatttctgttccatgttgttggctagactgactcaccatctgaaaagcaaacaaactgacaaaggactagactgttccagaagccaggtttctggctgctggaggttaggaagaaagtattcactttctttgcctttttttttttttttttttttttttttttgttctgaaggctgtgatatcaatagagggaaggtgcttggaggggacactcttcttccccaagaagaacaggagttttgcatatggtacacacccggctggaagaaacaaatccagaacttcagatggacttggtatttgccaagatttccaccccgaaggacagtgatgagaaaaatgcccttaaaccatagaaaagtatttttttaagctaccaattgtgcccagaagcattttagcaatttatacaatatcaaccagtaccttaagccctgatgtgtatattcatatattttggatacgctccccctccaattactggctctctctccgtatgaaacagaatcctctggaatgcgaggaagtgaacgtttcggtgacttcttcggcatcagaaagcatcaggccgccacaagtgcctgcttttctgcaagaggctgcggtcaggggttctacctggccccggctcagaggcgtcatcctgggactgagcctgggcacacgctgtcctgcaccaggggtatgaaacggagcagtgtggtctatgaacgtccagaagctgagggagctcagaattgtgccggcaggaaagaaggcaggaggcccggggctgcttctcccgccccagggttaggcccctttccgcctggagcgtgaacctgggagctaaggctcttaagacttttatcactgtggagagaaggaaaaggaaaagcaggcactgcccctttcctcgcagaggtaggcggggaagctgaggatgccggatgcccacgcccacgggaaacacgtgcggtccctgagcactgtggccggtgtgcctgcgcattggctgtgcagccaccagccagcctgtctgtgcggccaccagccagcctgtctgtgcagcttaaagcaagattttaaatgcttcgggaaggtcataaatcctaaaggaagcgttgaaatgacgtgtcatggattaactgacctatgtctgtggaatttcggtaaaacattatcttgtcattgtagtttggtctcatttgaaaaacctgacagaggggggaaaagttccaggtatggaatgtggggattatctgtacatcctggggcgttaacaaagaaaaaaggaaaaaacaaaaaacaaacagaggtgaaaaacgccatagagcagagaggtagcaaaagaagtgaaatctccagcttataaacgaggaaatagtttttcaagtttagaatcagccttgacacacgcatggaataactgtggcattattgcattatataccatttatccgtattaactttggaatgtactatgttcaatgtttaatgctgtggttgatatttcgaaagctgctttaaaaaaaaaaaaaagatacatgcatctcagcatcttttaaaaaaattatatttagttatggcctctacactatttgtagatcatttttccacttgagaattttgtctcttaattctttaaaagcatttctgaggagatgagataagccctgggtctcagctacctgagaaaccctggaacatgcaggccactgagccactttgcttcaaccaagttatgtccacttccatgtcaacagaattgtttattgtgagggacgtacctgttaccccttgaccttgttcctgaggtttacttgtcctaggccaaatcagaattgaactcacattatttaggattgcatacatatttggttaaacccatgaggttcattcagttggaaatccagatgggaaatgaccagggaattaaattctggctacaacggtttgagctttagagagatggtttgcgtggcctgtctccacgtagacctgtctagagccctcccaccttccttccagagggcccttctccgtggtcatcctcacattcttcccgaaatgcagtggcacttacacccccacacggagaaagcaggaaaccccatggtatgaagccagacctccctggcgggcctcagggaacaggacgctcagactttgaatgattctaattttgaagcaaaaggttattttatgaaaggtttacattgtcaaaagtgatgaatatggaatatcaaatcctgtgctgctatcctgccaagatcattctgacggagtcggtctgcagtacactccagtgatgagccccttcaagctgcttagtagtaaccataaagaacacaattttaatataaaacctgtttgtcttttgttgtcgttgtttttcaaacttggattcacaaagtattctaaaaatgtatatataaaaaaggtcacggggggctaattgctggctggtttcctttcgttgctggcttatgatacctggttttcaggataaatgttcccagccgcctgccccccagaactgtacagtattgtggctgcactctctctaagggtagttgaagttgcatttttcttgttgttaaaaacatgttagaagcaatgaatgtatataaaagccccaactagtctgtttttctcctcccttttcttggcattgtctcagttattttgccgttggacagcattcctattttgtgtgacaggattcgcccctgaattaccatcggcgtagtgcatgtgttgacccaggtcagggttcagtagaacatgtttccagatggaggtcaagggctctagaaaaaagccacaaggagaaaagcactccagaacctccttggtcctcccgagccctcactgcacaaagcagttcaaaagagagagcaaaatgacagctcaccatcttctgcagcaaacagctcatctcagattttacggtggctgaaacgtctggaggtttaagatttggattaaagtcacatttcaaattaaggaagcacctcgctgtagttcaagccccaaaccaacatcctctgccccaggccacttatctctgcatagtcagacatgacctcccatttagatgtgactttgatttcattagtaaatatttatgcttaccatctaaagacctggtgctggcccagtgtgggaaattaggaagtggttataaatcaagaagagtttgaataatcaggattaaacttaaataagtaggacagtcccaacatgcatctggctttttctgcatcgaggatctatggaatgaatagaattgaaaattgtctgtattgtcgttaaacttatgctaaaatgatgaatttatacatgtgaacctaaattctaatttccattgtacttgtaaggcagcagctgttttttcacttccttatcacctatagttagtaatgtatacctcctctatcagaaaaaaaaaaaaaaaaaaaaacaggaagggcttgaaatataagccattt

SEQ ID NO: 42 - DNA, 3697 bp, Homo sapiens
attacaggcgtgaatcaccgcgcccaaccacaagttacagacattataacatttcatctctgagttcattttctaaatgatatctttcctcctgaataccattatcaaatctaagaaaagaattctatgatatttcatattcagttcatactccagtttccccaattgtcctaaactattacagcgcggaagggcatggggtctggagaaggagagcagtgggaggatgcctgccttaccttcccccttcatcaaatgagagtatgtattgtacttgcctcatagaaggattcaatgaaggggtatggcacagttggtttcacacaatgagccctcatttaatgttggccgttattgctactattgttattgttgaaattgttgatgtcaatattgctatgattggcactcctgggaagcagccccaggacgccctccctactgggcctggtggaggattgggtgggccttcactcctgctccacgcccccgcagttactctgccgattgtgacgtcagctgacgctgggggcgggtgggggaatctggccggaaatccctcttcctgttgcagataagcccagcttagcccagctgaccccagaccctctcccctcactccccccatgtcgcaggatcgagaccctgaggcagacagcccgttcaccaagccccccgccccgcccccatcaccccgtaaacttctcccagcctccgccctgccctcacccagcccgctgttccccaagcctcgctccaagcccacgccacccctgcagcagggcagccccagaggccagcacctatccccgaggctggggtcgaggctcggccccgcccctgcctctgcaacttgagcctggctgcgacccctgctctgacgtctcggaaaattcccccttgcccaggcccttgggggagggggtgcatggtatgaaatggggctgagacccccggctgggggcagaggaacccgccagaggtgagcgatgaactgaggactagatgcctgggtgtctgggttaggaaggacctgggggactagactcccaagaagccgggggcctggactcctgggtctaacagaggaagagagctggggtccctcactcccaggaccaagattttaggctcctggggaaggagggagcggaggcctggactcctggctctgagggaagctagggctggggcccagactccagggcctccaagtgtcaccagctcacccattgccatctggacttttcccgacccagaacattcagaaggccttcatcgcatccatggacctgtggaactgggatgaggcatccccacaggaagtgcctccagggaacaagctggcagggcttggtaggctgccgaggctgccacaacgtgtgtggggagggtgtccaggtggggcctctgctgaccctaaccccttatcgcctgcagaaggagccaaattaggcttctgtttccctgatctggcactccaaggggacacgccgacagcgacagcagagacatgctggaaaggtggctgcgggctgggacccctaagtgctggagaagaagcggggaggctgggatcctagggcaaagggaggaggggggcgtgcctaggttcctgggactgggtggggaggggccgcgtgcttgacccctgagggtgaaggaaaagggggcgcggggtgctgaaatacgggctggggggccataactcccagtccctgacaagtagagactagagagtgggtagttgaggggtctctttcattgctcacagtcctccctaaactcaggtacaagctcatccctggcaagcttcccacagctggactggggctccgcgttactgcacccagaagttccatggggggcgggtgagtgtggggagaggcggtgggaggtggggactggggtcccgaggcaccggggctagaggtgtagactccctgatctttgaggactgagaacacctgcgccctcaaggtggcatgacctggatccgggtcagccgggccccaagtgccagggttgagagcttagaccctagagtttttgagggggcacctgggctcccctcactcgggatccgttactcctcacagagcccgactctcaggctcttccgtggtccggggactggacagacatggcgtgcacagcctgggactcttggagcggcgcctcgcagaccctgggccccgcccctctcggcccgggccccatccccgccgccggctccgaaggcgccgcgggccagaactgcgtccccgtggcgggagaggccacctcgtggtcgcgcgcccaggccgccgggagcaacaccagctgggactgttctgtggggcccgacggcgatacctactggggcagtggcctgggcggggagccgcgcacggactgtaccatttcgtggggcgggcccgcgggcccggactgtaccacctcctggaacccggggctgcatgcgggtggcaccacctctttgaagcggtaccagagctcagctctcaccgtttgctccgaaccgagcccgcagtcggaccgtgccagtttggctcgatgccccaaaactaaccaccgaggtgagagggccgcaaagactgcggggagggcgaagctggagtcctgagccgggacccaggcacctaagggggcggggcccgggagactgacagtgagggggcgggggcttagggaccaggggctcgaaggaggggccggtggcccgcactccaggtccttggggaggagagggctaagaaactggtagtcttatagggaccaaggggatgaggacccaggctcctggattatataaaacgaaagcgataaaggcccagattcctgggtctccgagatggggaggccaaactcctaaatctctgagactggggccctggacgcttgagtctccaaggctgactgttggatctcagagaagggggggcggatccccttctcgggtcctgggtcccgagttgggaggacccggacctctagatcattgaagtggtgtgatctagggccgggaagactgagtgtgcccctcccttcatcccgcaggtcccattcagctgtggcagttcctcctggagctgctccacgacggggcgcgtagcagctgcatccgttggactggcaacagccgcgagttccagctgtgcgaccccaaagaggtggggcagctcccctgcccagccaaatccgccccgtctcttctagttcaatttagctccgcccaagggctaggttcaaccgcgtagccctcggccccgccgctccccggcccactcgaggccccgcccaacccttctcaaacccaatctcccgcctgtactcctgcctcaaccaacccagtctccaccgggctctgcgaggcctcgcccaggtctgcactgcacaccgcccccaggcccggccctccccactatcgccaagccccgccccttcccactccgaccgagcgggcctctgtcctaggtggctcggctgtggggcgagcgcaagagaaagccgggcatgaattacgagaagctgagccggggccttcgctactactatcgccgcgacatcgtgcgcaagagcggggggcgaaagtacacgtaccgcttcgggggccgcgtgcccagcctagcctatccggactgtgcgggaggcggacggggagcagagacacaataaaaattcccggtcaaacctc

SEQ ID NO: 43 - DNA, 3609 bp, Sus scrofa
acttccttacgcagcgggtgcagctctaaaaagaaaaaaaaaaaatttgcataagtgtgtcccaaatattgcatgcatgtaagtatatgttacaagtatacatgggtgggtttttttggctgagtcattggaaacaaatacagacatcataacacttcactcctaaatacctgtttcataaccttataaagatagcttccatatcataataccattatcacatctaagaaaatgactaattatctcatattcagttcatactctaatttcctcatgtgcctaaactatgacagcatggaagggcatgatggattctggagatgaagaaaagtaggaggaaacgcacctcaatttcccctttcataaagtcagggtaagactagtacccacttcctaagagaattaaacaaaggcccatggcacagttagtagcaagcaatgagccctcaagaaatgttaaccattattgtcactgttgttattgtttatattgttgatgttactgtctgctgaagcagccccagaacttcctcctcaaagccctcgaaggggaaaacagcctggtggaagatcccaggtcgaccaaccaacccccaccatatcccccgcaggccccctgcggattgtgacgtctgctgaccaggggtctggccggaaatcccccttcctgttgcagataagcctggtgcagcccagctgaccccaggccctcctcccccatcacctcccttgtcacaggatcaagtccccaagcccccttcccctccccattccagtcaacccagaaacacccctctgcaccccaggtcatgcccatcccattgtttcccaggctcctgctcaagtccaagacaccccaaagctaccgtggaggcttgaggccatcccagggggcagaggtgggtggggagggggtggcacagcttggccccgcctcggcccctgcaacttgacccgggctgcgacccccgctctgacgtcttggaaaattcccccctgcccaggcccccagaggagggggtatgtggtatgaaatggggctgagacccctggctgggggcacagggatctgccagaggtgagccatgaacaggggactggaagactgggtgtctgggggcccttcctcctggtgagagagaaaaggacactggaggccaagattccagggtcctggggaaagagggagcagaggcctggattcctccatctgagggaagcaggggatggggcccagactccagggtccccaagtgtcaccagctcaccctgtgcttttttttcttttgacccagaacattcactactggcatccatggacttgtggaactgggatgaagcatcgccacaggaagtgcccctggggaacagactgtcagggctgggtaggctgctgggctgaggccatgtgtgtggggagcttgcccaggtgggagcatccaccgaccctgacggggctctaaccttactgcttgcagaaggagctgaattcgacttctatttccctgaactggcactcccaggggacaggctgacagcggagacatactggaaaactggctgtgggctgggacctcagggtgctggagaaggtgagaggctgggctcctaggtctgtgggaggaagggggagtgcctggattccccgggttgaactgggagagggatgtgggcttgaactccagagcttggaggaggaggaggagggggccagggtcctgagtcctaggcttgagtgagtaggggctggggtcacaactctcgtcccgaacaaataaagagcgcaggtgagtggctgaggggagtctgtagccactgtgcacacccctccctaaactcagcttcatccttatctgtcccagggattccacagccggactgggtctccgcattaccgaacccagaagctccatggggcgcgggtgagtgtctcccacagtaactggaggtttcgattccgcgatcttggagggggaacgggactaggacggggatgccggtgtcctcaaggtggcaggtcctagatccgggagcgtggggccccaggcgccaaggctgagagctttgactcctagaacccccgagggggcaggggatcgggacacctgggctcctctcacttggggtccgttcgtcctcacagaacccgtccctcaggctcttccgtggtccggagattggacagacctgccgtacagcggctcggtcccttggagccgggtctcccaggccctgggccccgcccccttggctggctcggaagaggcagccagcggaaacagtgccacctccgctgaaggtgccaactcttggtcgcgcgccccggtcgccgccagctccaccagctgggactcttctattggccctgacggcgccacctactgggacaagggcctctgcggcgagccgcgcgcggactctgccactccgtggggcgggccttcaggctcggactataccacctcctgggactgggggctgcacacggattgcaccacctcttcaaaggagtaccagggttcagatctcaccacttcctccgtaccgagccagcagtcggaccgtgcaaccttagctcattatcccaagacgaaccaccgaggtgaggttcccgagactttgtccccagggagaggacccggagtctaacgaggcggggcctaggcgccttaggggagggacctgggaaactggcagggctccagaggggaggggaccgtgcccttgctcctgggtcttgagggaggagaggactgagacactggccgtcttctgggaagcaagggacgaggaccaaggctcctggattaagtgagaagaaagggatgagggtctggctgcctagatttccaaggtggggcagccaaactccttaatcttagagatgggagtcccggatgcctgggtccccgaggccaactcttgggtcccttatatccggacttgttggtcccgaggaggagaggatccggactcctgggtcatcgaaacgacatgatctgggaccagggaacctgagtgttcacgtgcccccaccccgcaggtcccattcagctgtggcagttcctcctggagctgctccacgacgggacgcgtagcagctgcatccgctggacgggcaacagccgcgagttccaactgtgcgaccccaaagaggtggggcagcttcccaccccggccaagtccggtccctgtctgctagtgatcccttagcctcgccattcgctttgcctagcgctaggccccgccccccgcctcgccctcatctcaactctgctccgccccgactaagcactgtgcagactctaccaggacccccccccccccacgcccatctgttgtcaaggcgagcccctcccgccctctcggactaagccgggcctcccaactaggtggcgcggctgtggggcgaacgcaagaggaagcccggcatgaattatgagaagctgagccgaggcctgcgttactactaccgccgcgacatcgtgctcaagagcggggggcgcaagtacacgtaccgcttcggaggccgagtgccaggcctagcctatcccgaccgcatgggggacggacagggagcagcgacccaataaaaatatctggtcaagc

SEQ ID NO: 44 - DNA, 3209 bp, Homo sapiens
gctcctgtcatcgaggcccctggcccaatggcaggctgagtccccctcctctggcctggtcccgcctctcctgccccttgtgctcagcgctacctgctgcccggacacatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaaggtgaggaggaaacacaggcccccttctcccctcctgggtcgctttcgtccccaagaaactcagggccaggaggaggagacacgcgcccttgggccgagggctgggctgcggcggggggttcagaatgtaagatgcctggtgttgtcgccaggctcccgcgccccgcgtccaatcggaggttcagaggaaatgccggattgaaaggatcagaagcaagagaccaaaaaacgtttccccccggcctaacaaagccccgggcggcttcggctctgctcctgggtctggtaggaagttgagaaatcggtttatggtagacagaacagagagacaagcagataatctctgtttttaaatctcctttggatttacgaatctttttaaagatctgatgagaaccgctaaacagaaattgaaatgttgctcaccagacagcttttgcgtacaatcggaggagggtcctggaccttctttctgcagcccacccacgacccgggtttctggtgcctttctttctttgcgccaggaaagtggagtctgggatcgagggccttgattttaaaatgggatactgcggaccctcaggaatctgacttcactttattttttcagcacaacttgccggcgcggccagggcggagaggttccctcgtggaaaagttaggaaatgctgcgctaccgcgggcacaagggagtggacgagatgagtgcgggatcatcccgcaggccatcccaggatcggggagggaggccggccccgctgcagaaaggggccttctgggagaccccccagcccaaggcaggagcccgggcgattcccgggaggccgcaggcgctgggcgaagcgctgggcgaagggccgctgccagccgggagagaattcataggtttgttgaggagcagaggcctgggaacaaattcgggcgggcacggcggctagaactgatcgctaccaattcgaggaagccagcaaggcaggttccgaggccgcctgcccacccgcagcttcttggacactgcgcaaaccctgctgcggccaggctggagcctccgatcaccaaaccaacactccctggccttctgtttcttgattccttaattttgagataagaccgtccctagcagtgaggcctcggcctctgttcatttaacttctcaaaccaaactagccctaattcagttcaccccagagcatcacctggttttatttttatttttttatttttttatttattttttttttttttgcagcctgaaattttaagtcaccgtctgtctccctcaccagggtgtgaactgccccgagggcagagacctcccgttttgttctccagcgccttgagccagcctgactttctacaaatgctgagtgagacgtgtcggtggctcccagtgcacttggcagagtgagccgcagccagctgggcgctccaggcaggacacagtggcctccacgaggatcccttaccattactgtgcggccgcgctccgtaggtcaagccgctcttaccaagcgtctctctgcctctctgttccccctcagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgcaggatcgcggtgccagtgctggtgcgcgatggcaagccatgcctaggggactcggcgccctacgcgcctgcctacggcgtgggcctcaatccctacggttataacgcctaccccgcctatccgggttacggcggcgcggcctgcagccctggctacagctgcactgccgcttaccccgccgggccttccccagcgcagccggccactgccgccgccaacaacaacttcgtgaacttcggcgtcggggacttgaatgcggttcagagccccgggattccgcagagcaactcgggagtgtccacgctgcatggtatccgagcctggtagggaagggacccgcgtggcgcgaccctgaccgatcccacctcaacagctccctgactctcggggggagaaggggctcccaacatgaccctgagtcccctggattttgcattcactcctgcggagacctaggaactttttctgtcccacgcgcgtttgttcttgcgcacgggagagtttgtggcggcgattatgcagcgtgcaatgagtgatcctgcagcctggtgtcttagctgtccccccaggagtgccctccgagagtccatgggcacccccggttggaactgggactgagctcgggcacgcagggcctgagatctggccgcccattccgcgagccagggccgggcgcccgggcctttgctatctcgccgtcgcccgcccacgcacccacccgtatttatgtttttacctattgctgtaagaaatgacgatccccttcccattaaagagagtgcgttgaccccg

SEQ ID NO: 45 - DNA, 3152 bp, Sus scrofa
cctgtcaacgaggcccccggcccaatggcagcctgagtccccctcctccggcctggtcccgcctctcctgccccttgcgccccgcattacctgccgcctggccacatcccgagctggaaggcgggtgcgcgggcgcgcagcgggcaccatgcagggaggctgccagggaccgtgggcagcgccgctctctgccgcccacctggcgctgtgagacgcgcgctgccaccatgttccccagccccgcgctcacgcccacgccgttctcggtcaaagacatcttgaacctggagcaacagcagcgcagcctggccgccggggagctctccgcgcgcttggaggccaccctggcgcccgcctcctgcatgctggccgccttcaagcccgaggcctacgcggggccggaggccgcagcgcccggcctctccgagctgcgcgccgagctgggccccgcgccctcaccagccaagtgcgcgccctccttctcagccgcccccgccttctacccgcgtgcctatggcgaccccgaccccgccaaggaccctcgagccgataagaaaggtgaggaggaaacacaagcttcttctcctctctggggtcgttgttgtcctcaaaccccggcggacaagaaactctggccttgggtagaggagacgcgagtgcctgggcgaccggtcgagcaaagggggctccgagtgtgagaagcgaggctgtcgccagggcccccgtgcccgagtccagtcggaggtttagaggaaatgctggatcgtgatgatcagaaaccagagacaaaagagaaaaaaacaaatttttttttcggcctaacaaagccccaggctgcagcagctctgctgctcgatctgttagcgatgtttgtaatagacagaacagagggaggaagagagaatcttttttgttaatctcttaaggatctttttgagcatctgacaaaaactgctaaacagaaatgtaaatgctgcacaccagatgtactttcgtgcacaataggagaaggtccaggacttctgtagctcacccgtttcccagtggtcctgggggcctttcctcctttgtgccaggagagtggaatctttgagaacaggatcttgaattaaaaatgggatactccggggcgcttgggaacctgacttaacagctttatttttccataacaatttccccacgtggccggggccaagaagttctctcctggataaagttagaaaatgccctgcgacaaaaggcttgggtcgatggagctgactggggaaggtggcaggatctctgcgcacatccccaggtccagggggaggctggcctggaggtggaaaaggcgccttggggagctggccccccgcagggtcctttccaacccgaaaaggccagggttctttctgtgaaccaagatttgtctagtcgcagaggaaggccctgggaacagctgccggtgggcacggtggcttgaactggttgctaccaattcaaatctaactcgagcacagtgacaggcaagttctgaggccgcctgcccacctgctgctttttggcggctgtacaataacctgtggccgtcgcgggtgtcttccataggtcaccaaaccagcacctcttggctgtttcttcagttgtataattttgagacaatgtgaccgacccttaggtcttaacttttcagacccaagtagccctgatctaattcacctcaatgcatcgttgggctttattttctttgcagcctgaagtcttaagtcactgtccatctctctcaccagaatgtgaactgcccgaggacagggacctctcatttttgttctcctatgcctatagccctacctagcacatagtaggcattcaacaaatgctgattgtcaagcggaaatcgagtagtctaggtgcccagtgcacccggcggagtaagccgcacccaagctggggtctgaaggcaggtcgggatgccacccactggggcccatcaccgggcgggagctccgagggtcgcaggtccagcagctctgacctagcttctctctgcctctctgttcccccccgcagagctgtgcgcgctgcagaaggcggtggagctggagaagccagaggcggacagcgccgagagacctcgggcgcgacgacgaaggaagccgcgcgtgctcttttcgcaggcacaggtctacgagctggagcgacgcttcaagcagcagcggtacctgtcggctcccgagcgtgaccagttggccagcgtgctgaagctcacgtccacgcaggtcaagatctggttccagaaccggcgctacaagtgcaagcggcaacggcaggaccagactctggagctagtggggctgcccccgcccccgccgccgccggcccgcaggatcgcggtgccagtgctggtgcgcgatggcaagccttgcctcggggactccgcgccctacgcgccagcctacggcgtgggcctcaacgcctacggctataacgcctaccccgcctacccgggttacggtggcgcggcctgcagccctggctacagctgcaccgctgcgtacccagccgggccgcccccggcgcagtcggctacggccgccgccaataacaacttcgtgaacttcggcgtcggggacttaaacgcggtgcagagcccggggattccgcagggcaactcgggagtgtccacgctgcacggtatccgagcctggtagggaaggggcctgtctggggcacctctaaagaggggcactaactatcggggagagggagggctcccgatacgatcctgagtccctcagatgtcacattgactcccacggaggcctcggagctttttccgtccggtgcgcctttatccccacgcgcgggagagttcgtggcagaggttacgcagcttggggtgagtgatcccgcagcccggtgccttagccgtcgccccgggagtgccctccaagcgcccacgggcatccccaatcggctgacaccggccagttgggaccgggagcccgagcccaggcgtgccaggcttaagatggggccgcctttccccgatcctgggcccggtgcccggggcccttgctgccttgccgctgccctccccacacccgtatttatgtttttacttgtttctgtaagaaatgagaatctccttcccattaaagagagtgcgctga

SEQ ID NO: 46 - DNA, 54513 bp, Homo sapiens
catgccttatgcaagagacctcagtcccccggaacaactcgatttccttccaatagaggtctgaggtggactcccacctcccttcgtgaagagttccctcctctcccccttcctaagaaagtcgatcttggctctatttgtgtcttatgttcatcaccctcattcctccggagaaagccgggttggtttatgtctttatttattcccggggccaagacgtccggaacctgtggctgcgcagacccggcactgataggcgaagacggagagaaatttacctcccgccgctgccccccagccaaacgtgacagcgcgcgggccggttgcgtgactcgtgacgtctccaagtcctataggtgcagcggctggtgagatagtcgctatcgcctggttgcctctttattttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggaggtgagtttcaccctggaggactgaggggggaaataggtttctctttgcacttggccctccttggcttttcaccccgtcttagtcttgctgaatcttctcttgctgtgctgctacttctcatgaacgaaataagaatggcttcgtgtgtcacctggcaagaatggattctctcgaaaggtttgaaaatccctattttgcttggtggcccagaccatctgtgctcaatgagctaagcaaatctggctgggctattacctgggagagtccagatttttcctctctggaggggcctgaagattatttatgggaattaattttatccccaaatctctgagaacttaaagggattgggaaggtctttctggatttccctttccctctactggagatgtagcggttcagccttcttccgatgccatgtttgtttttcgtgtcttcggcctagggtcgccttgccagcaagcctaaaggcctccaagctgacttggagggtgagggtgttttcacaaataaatacatcgcctgggcaaagggaaaatatctgtttgcaaacaaacctggaaggtggagtgagcaccatagcaaaggagggctggctttctccccggttgccccacattcagggttggagattctccactttggcattttgcagcaatggcctggcctgggattttagcagagcagtcacagagggttacacagctgctgacctcggggcatttctcctccctccatccctttctccagaccttgacttgcaggcccaagtctcttatcagaaccctagaaaaatcagtatgatgggggtacaggaggtaaggatgggaaacagaacaggactcctgacatttactccaagcaccaatattcggtgtcccaatctgggtctgctcagactgagacctactgactgtgtttgtgcttttattgacctcttcaactcaccctaaaaaaaaaaaatacatctcagagagggaaagggcaaggagaggagaccagtggagatgaaaaccctagccagtccccagtgactgtttgattattttaataaaactgggcactgccttgtgtacacctggagcaggggacgtctggtggccccactgggtggggggtgagggcccgcagcgatttcttagcatctttgatctcggcccccatcccaatgcaccttcaccctgccttcaccccagagtcgttgagagtaggggtgatgagtagggggtggaggggagatgtcaggaaggcgagcgccggccaggcggggtcaggcagctctccttctcgaggtcagcgttggagagaatgtctgcaaggctgcggaggcccgcggtgtgtttgtgtgtgtgcgtccagactcggttctctgcaccgccagcgtcactgagattacttcccgattagaagccgaccgcgtttgaaatgatttgtgcaggagtttttgcagccaccgcttgctcagagaagcagagatggatggaggttgggaaaggggtagagaggagggagttattgcaggtctgtgttgagagtcgtattgtgatttgagtgttcgggaaatctagtggaaatttggggtggggggaagggaggacgggagggtgggagggagagagaagggggagggcgacagagtgcagtgggagctagttggataggcgatttcagtactttgtgagcatcgaggcaacccaacgtcactgtgctcagctgagttggcttgtatttcagagagagagagagagggagagagagtgagagagactgactcttacctcgaatccgggaactttaatcctgaaagctgcgctcagaaaggacttcgaccattcactgggcttccaactttccctccctgggggtgtaaaggaggagcggggcactgagattatatggttgccggtgctcttggaggctattttgtgttctttggcgcttgccaactgggaagtatttagggagagcaagcgcacagcagaggaggtgtgtgttggaggtgggcagtcgccgcggaggctccagcggtaggtgcgccctagtaggcagcagtagccgctattctgggtaagcagtaaaccccgcataaaccccggagccaccatgcctgctcccccgcctcaccgccggcttccctgctaggagcagcagaggatgtggtgaatgcaccggcttcaccgaacgaggtaaccgtcccggcagatggcccgggaggctcaggagggagctcgtcggccgagtcggctggggcggcgggaatggcggattccagcccggctttgcattctgcagagcacagcttgcagagattttgcgcggctcggagctccccggcaaatggagtctgggaggccgccgcggctggcggagcggcattgaggtttgcagaagcacggcctggttctgtcaaaccgcatcttgttcgcctccgccagcccagagctccccgggaccctggcgagggcgcggggtaggattctccccgcggccggcagtgaatgggagcgcgtgtaggggcgccagccctgctttcttttgttgtgagtaggcagcggggctccagtcgccgcctccctgaagccccgagaacgaggcgaagaaagctgcttgcaagtcaggcctcagaagctgtccttctcctcggccccatttctagatctctggccacagcaggtcagggtgggatctggccgcttgcttaagcagctgctgaggttttgggggaccatcgcttgtgcccgcttcccaaagtcttcccgttctagggggaattcctacttgcgtatagaagagattggaaggagatcagagagcaggagacaggctcatcgggcttgaacagctctgcggcagttattttgtgtgttctaagctcatacgcctgcaaacccgggccgttctatgcattgcggggacccgggctgcagattcaatgtctccagcctaggacttatccgagaatgattttgtcctcgccaatcctgagcctgagcctgcagttttagcaggccaggcctggctgaagttcagagaaacccctttcggcctggtcactccacaaaatgcccgccatcccccgcccggcatcagagcgctggtggcgggcacccagtgacgagccttcctcggaacggctgcacggtgactttcttcatctagtcttctgtttggctactttttatcttttaacgaatcttacttaaggttgggataaagaaaaggatgtttaattttaaaggacttttaatgttaaggcctgtaactggtaaaaggtgtatatgaattctcttttgaacctagtctcaatctgcacaaccttccccttctgtgtttttctttttgcaagaggcgggttatttcacacatttctgcctgctgcagaaaactattcctcttgtgaggtttaataaaaagagtttcgacggcatcttgtaatttggcgaagaaagaaattctctaaaggacactgggtttttgttttgttttgtttttggttcctacccagtggcttccaaaaatacccacgccttatctttattggctcttccagaagtccagacaaatttgacgggcagcttgcttatcacggagagcctgcgcaggggagatgcgggcctcaccttctccgggtctgacgcgggtcttttgcaagaagttgtgcctgcttataaagtaatagtaatactactaggaatactagtaacagtaataattctagggccttctgcagtcaccttcggctgggaacggaggtgctggtagctggaaactgggggccaaactgctccctcctgtcactagaattgtgctctccaacctttctctcgttctctctctgtcctccccacccccatctccccctgcttcttgtcctcagagcagaaccttgcgcgggcacagggccctgggcgcaccatggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcaggtaaggagacctcgcgcttcgggtccctttgcagagatcaaagtcagagtctggctttcctgctcggcttctcttgcggggacagaacaaaaacaaaataaaaaaaccccaaaacgaacccaacgactataatcatcccttttcctttttattcccactcagttccacctttctctgccctgtctccccaaatgctagcgtattgccatctactttattgtgacggttatctttacggccaaaggatttttgaaatctatttaaattgttcgagaaatctcaattatccggccgtttggggtcagctaacaatggcctagataattcctttccctctgcactatgtgtagaatcggcccccagcatcttaataagggccaggtcagcggccgattcaggccggcatgagcgatggcttgacccctcttctgatcttccgtagccttcgcctcctcccgcctcctcctgcctcctcctgcctcctccgcgccgccgactagacccgcgcgccgcaccatttgtcttgcggtcggggcctggctggctggcgcgccatcaccggccgctgggagcgcacagagctctgcccggagggcaccaggagcctcgggttcgccaggctacaacctgggcccaggcagagggaggagcctcaccttgcgctctgcgcccaaaacccaggacgcactgggcgctcaagtcggcccctcagtagatcctggtaatttttaaataaggtgtcacatggggtgaaacggggtgacgaccagaagagacacttacacatggctaaaatcctgccttgggatttcgatcccttcctggcttttcccggcttctctctttggcctttaagtttcaggaaaacgtgtgtatatttgtagagaagcagagagcgtgaacacagtttaggaaacttagggatttttttttttcttttaaggaaaagcaaacccactttttagactgttgtaaattattccaaaatgaagagtttgtgtgtgcatgtatgtgtgtgtgcacatatgtatatatatgtatatatatacatttgcatcggttctgtaaatttagttttagctgaaagccaaaatgttaaatggcatcaggcgtgtcctataatcaaaatagctggatgtgaatggaactacttgtagagagagcctggaaggtttgttaatatagatatttaggattaattatccttctggactgtaagaatatatgataatacaaacatttttaggtttcaaaattcatgtatgttcaggtttgcactcaccatggtcgagaataagcaagtatttgcacatctgtatgtttgatgtgtgggcatctgagtgtctacatgagaatattctgagtggttttctagattaggttcctagtttttctaaattaggttttttatctatcccccccacccatctcaggtgaagtggattgaaattggctctggttttttttttttggtttgtttgtttggttggttttttcttattccggtcctcctcagtgacattccggagcaccctgatggtgggtgatcactccatagccttgtgctgatggcattagaagcagacaatacagcactgtgggttcaagtggttgttgcaaccctcagggattcagcctacatagggatccctgggcagaggctgttgggtgctccagataattctgcagtgggctgaagccactttttactctctgagaccacaggctccagcgggaaggaggagcagtctctgtgttttgggggagtttggggaaggaatgcccactactgccagggcttgttagtgtgacttttttctccttcttgcagggcatggagggaatcaaagtgtttctccatgaaagagaactgtggctaaaattccacgaagtgggcacggaaatgatcataaccaaggctggaaggtgagatggtttgttgtgtagagagagggacgaggagaaattgtgggagaggtgaagaagaaaaggtggcttggaagagaagaaggaaggaaaggggcaaaaggagagggaatatagagaaagaagagaaaggagaggagaggagagagagagcgaaagatagatcctggttaaagaggcacaaggagattcctccattgatctctcctaggatggaggaaatactccagaagttcaagcccggaaactgggcatttctcccacctcacatatagaaagaataaagagcttgggaggccgtgctatctggattcgtaatgagggaaagagagaagagggaaaggagaaaacagaaaacagagacccagagaagacagagtctagaaggtttttgggtttcagggatcttggactttatctttactccaatcctcattcccaccctccctgaccttggagtggctccagggtcccacccgattgtcaaactctgaatcgttggatgtattcgctacctctttcattgtttatagaaagcaggcgaagcctttaaaactgaaccggggctcggccgggctctatatacagacaccaataaacacggcagcttcgccaagacactcgccccggagttccccttaaaagctcgcagagttttagctagaaatgctagacttctgggggaggaggaaggagagtggtgcagctctgtatgtcagtgtgagtgtgtgagcatgtgcacgcgcgcgcccaggcctggggacgtcctggccacatccctacccgtgctggacgggtcttccgcgtcccgcaaagcaaaaagccagaggatgccccgagcaggcgtgtggagcaggcgaacggtaggcccaagccaccgagtgtgtgaagggggagggtggagccgcctttccagacgccccccgcccccgttctccagccgaagcctccctcaataaactgacaacagtgacatttattattatttaaaattaaacaaagtctgctccccgctcggcccaaggcctgagtgaactaggaggcgcgttctgtttatatcaacgaactgcagtcctcttcctattcccccaggaaggaaagacacgtccgagtccctctttccccccgagcctgagccgtgaggatttaactataaaaggcctgcgaagtcttctgcgcctccgcctccgggcgcgctcgctcaggctgataaacactgcgaggctttggctccggggctcggagggagaggcctccattcgaccgttcccgccatcgctgagtgagccgagatctgccaacttgtcttttcgccccgggccagccttgagaatctttgctttctggggcatgttcctcagaaggtggagggaaatttggagtgcgccagggcgcagaaaggcagcagagacggcacagttccgggccatcggcttgataacgactgaatcttagttcaggcctcagctttttctgaaaccagatctggaagggtctggaatttctttgctgaaggccaaggaatttcgactctccgaggaagagtttcaggggccttggagaagttgtgggggcattcaggaataaactcctgctagagacccatgtcagaggtcattaaccgagttatactgggaaccgcggccttccccttcctccagcggcagaggaccaaagcaaggtcgggaagcctgggcgcacccacgcgtgtgcatctctggggcgcacacaccttgtgtacacgtgacaccttagcaacgcgaggatcggcggaagcacctggctagacagatcctctaggatcagcgcctagcattgtacctaataagcctcctctccccacaaatattaataataggtgtctggctccgaaaagggcggttagcaagagttgaaatggaggtccctttgaagcatcttcaaaacccgttctctagaggcgcatgcgtcctggtttgttttccgcttaggttacctacagttgcccgcctgctgttacctcctcccttcgcctttctcctccctataacttcaagggaaacccgggatggatcttgcggagagcggaacggggctagtttccgcttccacgtttctccaggaattgctttttcccttaaaatggatggaggctgccttaaaatactggcattaattcccgcccccctctctccctccgtccctctctcttaggcggatgtttcccagttacaaagtgaaggtgacgggccttaatcccaaaacgaagtacattcttctcatggacattgtacctgccgacgatcacagatacaaattcgcagataataaatggtaggcactggggtggcaggtggagcggggagagagaaaagtggaaccttctcccaaaaagttgaaaagttgtatcagtgaactttttttttttttttagttcctactgtgtgctaaaggcgtctgtccgcctatcccattgctttttactaaccattctcagacaaagaaactacaacaattagctccggttttccagatgagaaagcggaggctcagaggaagtgaggtgcctgtgtctattgctgcacccacaggttgtggatttttacaaagggtattgttaccaagtgctggaggtatttctgggggcataaaaccatttacagttattttttatgagttacctgctttgaacatgcatttttatgaaattgcaaaatcgactcgtggtattcgagttaaacagttaggagaggcccatttcttgggtagaatcgttcccatggctgccagcagtgcaggggcctgacgatgaaacccccgttgaaagccctcaaggaattttcaaggctttttgcacgtccagacctccagaacccgccacttttttgtgggatgcgagaggctgtaagaagaaagggctgggccaggggcttgcctgggcgcaggcacaaagtattctggggcagctgggattgcagatacctaagggagacgggagagcctccagattattcccagctactactcaacaaccctcacctggtgcgtgaactgaagcacgcttcggtgcagtgcgctacctccagactctgagccaggcctctagtacacctctccttcatctaggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatgtgagtaccgtggcctggattccccgccttgtctccctcttgtcctctctcccttcttctcactgggtttctctcccttcttggctctgtgtgcctacatttctccttttctttcctccattttcccccactttcgtcgctttctgcctctaccttcttgatctggacttccttcctcttccttttcctcccctccgtctcaattctctcattcctttctcttctttcaccttctcacttgctttccctttgctttctttttcttcctactatttcatcctctgtctccactactctcctacacagacatctgcccctctgcagtcctcccggtgatccacactccccagatctgggtctgtcgttccttggtggctggagatatggcccccggctcacctggtctggggctgcatccttgccgttagggcccaaaccctctccctttgcctagggatggaggaatgattgaagctgctcattccaggcctggagagtctgtgaattcgatctgtggttaggagtggagggctgtgtttcagtcttgcagaaaatatggacctcctagcccagtggatacccagtatagactgcacagaggctggaccacaatgaaagccatataccttccctccccacttctcaatcctgccttaattttgggatgttccaggggagagggagagcccagctcacctgccccctcttttccagatgggaaatgaactcataagagaactatggtgccagtgccactttttagcttgatactcccggggagatctgttttttttccaacaaccagctttctccctttccacactgtgcccagagcaggcgaatgtaaaccagggtcctaaacttggagtctggattggacccaagagaggggactggtgaatttcctgaaactgaatgcagggtattgaatgtgcagcctgctcaccacccaaaagaatgtgtaggttttagtggattcttagtagggtcatcacccctcttccccaaagaaaaacaaaacacaaaacactgatttttgaaaaaatgtccccaaatctcatcgtagaagataattaattactagaacagaacacggattctgtattcacgtttagaacttttagctggatgattctgccatacaagtgggtacattcgtcttgggcatttgattctcacggcagcctagggggcggacgggaggcatagcttttgcacaggagagtccaggggacgggggtgacttgtcaaggtcctacagcttgtatttgggagcagagatttgcggctaggtctctctaattacaaaaggagttccctgtcctggaaggttgtagcttcaaagaggagcaacagataggcgcatggtcgccgatttcagggaaaggaggggactgggagggaatgaatttggtcaagggggcgggggaggatggtttatgaaggtccaaacgagaaatctgctcctttgaggccttggggctgaagcactgaagtccccaggatctgggatgggaagaggatctcaggggtccacactgatgggtaaatgcagctctcagcacgtgggtggagaggaaaaagaatcattcactctctgtgcagcctgcttggagcgctcggaaggcattcccaggcaaatgcagagccactctgttaaacccgggtgttttgcccacgagtccttcttgctgggcttcccaggaggtgctctgtaaattcagcttgtgtaggcattggctgacccgccctggctgtgtatctgccagtccccagcagatgccttaccagcaccagggaaaaccggagccatttctaaaggttccacatgcatctctgggctggctccttctggaggatgggacccttgggtggggtcctgcgtggtccttgacgctgggaagtgggacggttccccaggctcatttcagctcctagctttttctctgctcctctggagtgcctttggggtctctctagggcggatgcctgcggaaggtgcacaaccccaccaccaaattcctggcatccctgccagcttcaggacgttcccagctggggagaggggctcggagctgctcagaactgcctagaagccaggcattcccacccgagactccggacttttaattcagagccggcctaatgaaattaggagccattagatcgccctcgcgctgatgtctccacactgtccccagccgtcaaagcaatttggctaagccgggccgatggccccgccggccggggactgtggcggccagcggggccccgctgcgtctctctgtcgccacgccgccccggtcggcgtcgctatcggccggggaggcggccgggccacggcggccggagattagagacgcgcggcccggggtcgggcagccgcggggcccgcgagttcctcgtccctcccccgcccccggccgcggctcgcctcccccaactacctccactcgatcggggccggactccagggttggtccaagaatcttgccccagggtcatcaatgcaaataatcaaagtcacagagacaacctccgcagttcccgggaaaaagcaggccagattttcaggctgttaaacgcggcgattcgcaagttcggtggggatgtgtcagagcgttctggtaaatactagcgtcatcagaacaacaaacccagttttattggtgaggatgctcatctgtgactagccctggctccagcaagaacgtgcagcctggaagtcctcctcctcctcctcttcctaatgataatggtggttgtaaaaattacagcacaactacagcagttaggacccctcttgtccctgggaacacccctaaatatggggaagataggaagtagaaagagaatattcccgaaaaagcagatgtagccgttctgtctggggccaagcgtggagataattctggttgtggatcctgaaacgtgataaagctggagaaagggagtttccaaggcaaccagccccttctttgaggggtgtgggtggtgcttcctccccacaccttatgagccgacatccttggagggcagatcacccgtgacccccaaatatcttctcttttcacgaactctgctttgcttgttctccaaacaaaggccccagatttgaggtctgatcacccaccctaagcctcagaaaaaggctgtgcagagaactggtgatttttttttttacttatttcagttttccaaacacttgatatcttctcttgcatcccttagagatttggggagtgggggttatttctatgtttgttgtttgtttgtccccgtgcccctacaccacctgtcaatccaaaagtgcccttgaggcttccctccagacgcggattcctcgatccagacttgctcagctcccgttgggggtgggaagtgccctatgcagggagttaatttattaagcaaactttattaagaattctgatttactgctctgtgtgccttgggtagattcctggaatattaccctggctttttcggttggaaattgttatttttgaaatgtttctttttaatgaaatccctggccccttttcaaaacagaagaaaaatatctatttttcgagagccgatataacaaggcgaatttagagggcggggagcagggttttatctggagacaaagggagttttgattttcttacaatctcattttctttattatttttagattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaaggtaagcctgaagcccaggaaccagtgcctggggccgtctgctctttcttttgcatgaatctgcaaggttttcctgctggaactttgctcctctgaatggcagcagtcaccaacttcgaccccagggtgctggggtggggacaaagctgcagcctaagagtttcagctgtttttactatatccacgagcttggcttgacagtcaccaccacacatatgcacccacaccagttagaaacaaacttgtcaaaccatagatgggccacacactcaaataccacaagaaggcatcccactgaccttatgaaatgcctagtgggaagaaaggttgcttaatggctctggtgctgccatttcatttctgggcaactgtttctgctggggtcagttttctcctctctgcctttttaatatttttcactccgagacagggtctcactctgtctgtcacccaggctggagtgcagtggcacaatcatggctcactgcagccttgacttcccaggctcaagagatcctcttgcctcagcctctggagtagctgggactataggcacacaccatcattatgctcagccaatttttaacttttgttttttgtaaagacggggtctctctatgttgccaggactggtcttgaactcctggcctcaagtgatcctcccacattggttttccaaagcgttggtattacaggcatgagccactgcacccaattttgccactcaactggcaacagcacaggtggcaaagttgccgggatccttaggattggactttcctgatgcttccctaattgtttcagaaatcactgactccagaccacattcttgggaaaggtttgccttgttaaaatgaaaacagagcaacctgcaccaccagcagcttgggataacactcccaagctggacttagacaaagagcctgcagaaccacagcttggtgaggggaggcagacctgcattgcttgggagaaggtggctgcagtttggtgtaggggcggtatgctgtcgcatggattgtgtgaaagtcagaccccatgaggttcaaaatccaggcactggttttggcatttcaaagcttgacaatgactttggagcaggctgcctatagcggcaggttggagggtgggggaggatcttctctttttcctcaggagaaagtttgtctcgacttgtcaggattcacctctgttccttagatacccgagtgcatgtggattcattttattgtgggtggcaggagggatttaatgttctaagccttggtatgaaaagttctagaatctggagaggcgagcaataggtgctgggggaggggcccctgccctcgtgcggttgtagactgttaggagtattaagcagtgatttgggcttagaaggctctggaagggcaaagtgggaggggggtccatatgggatctgtgagggcaggtcacctagatggatgtggagatggtgtgcccctcccttttcttagctacagtccccaccagcaaggctggggtggagggggaactgcaggagctggggactggacaggagaggccggagaaggatgagaggaaggcttagcaccccaaatcctcccctcacccctcgaaggtcattccagtgcaggctggcttggcagagaataccccaactgaggccgggactgttccaaaatgctgtggctaatctccaaatccagattgtctgtgaacaggccaagctgtgatagacagtcctttccaggccacaaagcctgtctgggaacccaggtcgagagagagcttcctgccctcggaaagaaaactcattcccctcaagacaccattcctttttaaatgggtaggaggatttttccgagtatccttccacctgttgaaccagcaagagcaaaaccgagggtcgaatgccctgaaagatgcaaaactatttcaggccaatttgagtctgtctccttgaaacctgtttccctcaatggctgctgtaaacctgtgtttagctttgcggtgacggtcacaggaaaaaaaaaatagcaataaggaagctcaattcttcctatatatgtatatacttacatgctctcagaccagactggggtccaaaaatatatgagatcttttccccctctaccccaagaaagcccaggttcatacaggaggataggaaagggtagacatataaaagtgaccggcttaaaaaaccatctgaattctcaggtcctttggaagaaacaccctaaattctgtgtagttatgttcttaagactcatcaggtgtggatagatgtgggaaaactcactccctctctccctctttctgttgacagccttattgaggcataattgtcatctaataaactgccatatttgaaacagacaactagataagcttcatgtgtatatatatgtatacctgtgaaactgtcactgcagccatttgtgaatatgcccaacaccctttacattgctatttaaaaaatttcttccccaatacacgtatttagtgattgatgtgcatgaatgcctgcctgcccaatggggtgtgtatgtgtgattttttttttttttttttttttagcgcaatccagggaatcgtgtgtctgaatgctcacaggtctaagaatgtgtgtctccaaatacgcatttggatatatgcgtatttcacggccacactaagtgttcacacacaataattgcttttttttctgtattgattgagtcagggagcccagttgagctgtgcataatgttctgtttagccagcctgacagattccttgacatccgggagagaaatttcatgggagacaactttctgttaccctcccccacttcttcctttagagcaccaaagacacctattttctttttcaggagcaaatccaaaactgtgcactttcccagtcaagtgcagggcccctgcaaacatttcccacgtggatatatgatgtgtgatttaaataagcgggccagggttgcatgtgatttgtggactcagtcttgctactttattgtcccacctggactgggtgttgagacttctgacttcatgcgtagaagccagctgagctcaccatcgcatagggttaaggtggaggactgtggaagctgactgcttgggttcaaacctatctgactttgggcaaatgacttaactccatttccccacctgtaaaatggggataataagagaactcacctcatagtgttgttgtgaagattcaatgagataattcccggcaagtgtgtcatgtgggacctggcagagagctagcacagagcattagtaatgattgatggaccattgattgactacttagcagatcagtttattaacagggcgactccatccaaaacacagacttcggaaaactctttgtttactcattctaacttcctggctagtttagaatctgaaagactgggaatttaaataagttcttattcctgtggttgaaaaacaactgcaaatattagtctttgtggtttagttggctcattccctgatcatgttatcaattcaaggactatttgtctagcgttttgccttggataaatgagcagggaaaagaaaagcaatgcatgtgattaaattgccaagacaatttggaaaaataagggccaccgtttttatggtcaaagggcccagtgccttcagaatgatctgtctctatttggatgtaggtaccaggtggaggtaggtaggctacatggttcatttcttaggctgcaatcacatacccatataccactgggcccctaatgacgagacacatttcctcagcccagctgtgatctcgggctggatttgggacttatttccccagatggttgacagcttaaaaaagatatttaaaaactcaaatcttccccagcgacgttcattctgtgaaacacgtttttgtaaagttttcactgcagttgtcagcagctcccagtgcaatccctagaaatatttaggtgttaaaaaaaggtcacgtgggcatttcatttccctgttcttgcaacaatggctgtgtatgcaagcaatgtctatccccagatattaacttaactttgccattaaaaggcattttcctcctgcttaaatcattgtgtaaggagtctatatttatgaggtatgagctttctggttcagaccaggaaatgaacccttaatagagagacataattaagatttttggtcctcgtgagggttttaaaaaatttttttcaaaagcaagaattcacaacaattattctcattaatttttacaacctctgtctcagttggagctggtatttatgtttgtttttcccccactcccaaatctctcccggatatccggttttatgttgattttgaagggagtacatttgcatggtgaatagaagtcagtttcagtgaagccttttggtggaactgggaaatccaggtgtatcagtttgtgtgcccatgatctaacacacagcatattaggaagggaactttataaacatggttacagtatgtgagtggacagatattttgacctgcagacaatgtatgttgtatgttgacatttctcaagggtaattcttaggtcatataggcatctataatcagtttccaaaagaagttacgtgtaaagatcaacatacctaagtgaatatataagaaattgtgcttatcctgtgcaatcatatttttgcaagctatgatggtaagtgcaagattgggtaacagccaatctgtttgaggtgcaaggaatggatttgagcaaaaggtttttgctgataacataaaattcacccttttcttctttccttggggcaattttttgttctgagttcttggtggagcatggacatcatggactgagcactaattctcatgctgagatcctcactaaattctggtgtcacagcctcaccatcttcgacatttacttctgagactgcggtggggcaggctgggaggtgggaggaaaaggtgtccttcatccacttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggtgcccgccactacgcccggctaattttttgtatttttagtagagacggggtttcaccgttttagccgggatggtctcgatctcctgacctcgtgatccgcccgcctctgcctcccaaagtgctgggattacaggcgtgagccaccgcgcccggccttcatccacttttaaatgatctatttctccttaactttttgcaagtccattaagagatgatttatggtcaactgggtgaaatttcattgtgataaaagctgagtgagaaagaaaagtcccattagatgttgggtttttagactcttaaaatacaagtgaatacaggagtacacatcttaagatgactttccaaaaggattttatagatttttctactcattcagaagagtcaagaaaaaatctgaggccaagcgtggtggctcatgcctgtaatcctagcactttgggaggccgaggtgggtggatcatttgaggccaggagttcaagagcagcctggccaacatggtgaaaccctgtctgtactaaaatacaaaaattagccaggtgtgttggtgggcacctgtcatctcagctactcgggaggctgaggcaggagagtcacttgaacctgagaggcggagtttgcagtgagccaagatcgcgccactgcaccccagcctgggtgacagagtgagactctgtttcaaaaaataaaatataaataaaaaatctgaaagctacaggaatagacacagttaaacaaaaatgggctgggtgtggtggctcacaccttaatcctaacaatttgggaggccaagagctggaggattgcttgagcccaggagttcaagaccagcctgggcaacatagtgagactctgtcactccgaaaacctaaaaaaaaaaaaaaaaaggttgagggagggagaatgtgtacacacacacacacacacacacacacacacacacacacacacggatactttaaaaatattttaaaataaactttagggtaggaatagtggctcatgtgtataatctcagcactttggaaggccaaggtgggaggatcactccagcttgggaggtcaatgttgtagtgagctatggtcactccactgcactccagcctgggtaacagagtgagaccctgtctcaaaataagtaaataaataatttttaaaaatacttggctcagctgggcatggtggctcacgcctgtaatcccagcagtttgggaggctgaggcaggcagatcacctgagatcaggagtttgagaccagcctggccaacatgttaaaacccttctctgctaaaactacaaaaattactcaggcgtggtggcaggcacatgtaatcccaactacttgggaggctgagacacgagaattgcttgaacctgggaggtggaggttgcagtgagccgagatcgtgccagtgcactccagcctgagtgacagagtgagactccgtctcaaaaaaccataacaacaacaaaaaacctggctgggcacagtggctcagcctgtaatccctgtactttgggaggccaaggcaggaggattgcttgagctcaggagttccagaccagcctggacaacatggcaaaacctcatctgaactgaaactaaaaataaaaataaaaaaattagcccagcatggtggtgcatgcctgtggtcccagctgctcgggatgccgaggcaggaggattgcatgagcccaggagtttgaggctgcagtgagctatgttcgcactgcagcactccagcctgggtgatagattgagaccccatatccaaacaaaacaaaaaggcttcattttttagagcagttttagtttcacagcaaagttgtgcagaacataccaagatttcccctatagcttctccccaccacatgcacagccacccccaccatggacatcctgtaccagagtggaacattttttgcagttgatgagcctacactgacacatcatcatcacccagagtccatagttcaccttagggcccactcttggtgttgtacattccatgggtttggacaaatacataatgatgtgtacctgcctttatagtatcatagggagtagtttcacaaacccaaaaatcctctgggctctgcctattcatccctccctctttccaacctgtggccaccactgaccttttaactgactccgtagttttgctttttctagagtgttgtatagttggaatcatatatcttaaaatattaattgtatgtatattttttatggtgaatacacataggtgcacatacatataataattttattttcaataattttggggttagaggtaaacctcataggtcatctcttccagaaggcagaatagataagaattcctctcttcaaatgaagaaattagagggtacattcatttatcaagcacagtttctcaaatctgtaactatactactgggaaagactcgagatgatttttagggatacttgaatatgatgaaatcacagagaaagtgttttttgtttgtttgtttttttgttttttgttttttttttgagacggaattttgctctgttgcccaagctagagtacagtggtgtgatctcggctcactgcaatctctgccgcctgggttcaagtgattcacctgccttagcctctggagtagctgggattataggagcctgccatcatgccaggctatttttttttttaaattttgtattttttgtagagatggggttttaccatgttggccaggctggtcttgaacttctgatctcaagttatccacccaccttggcttcccaaagtgctgggattacaggcatgagccaccatggctggctgaaagttgttctttttaaaattatctttctagtcttctattagagagggagtctcagttcagtactggtttgtgttaactagttctctaaaagtgtctaatttccacttgcaacaaagagaaggcaagctttggatatgagtaaagacaattacatatatttattttcttcttattgagtagcaagtgattctagtttgtcatacaaagaagtgatatcatatttgtgtgaaataagtgcaaattaaaagtggtttgatttaaataaaaatattaagccagtgtacaggtgctgtatagatatggcaataatagtgaaagaaaaccttgaatgactgaagtttgagtcatgctgctctcatgtctataacatgattctctatgttctctatgaaaattcagttcacacgcaatttttaggaaatacttctggcaaactccgtatggttgccttctgtcacctgggtctgctactgtacattcacactaatataatgcgttgatggattaaattaaagttctgggcctggaaccaaaacgtgcaaaaagaccctgttctgtaactatgccttgtatgttgcaacacagatttccaagagagaaacctctcttctttgcttaggacattaaagaggtttggtgctgttcaatagctattatataagttatcattatgtatattggcgtttatttcattaggcaccattttccaccagaactaggaaacgctatctgcaaaactatgaaatgaacatgaaatgaggcataatagaatttttgaatgcaataatcaagacatgttttctgcagaaacacacgatggggtcaacccttccaatggagatgactacgctgcctgatgtgcaacgatcatgtcaacatgcacagctttccaaaggggagggagtactgagtattgaggcctagatggtgtttaaaacacaaaatgcaagattggaaaaaaaaaaaaaagaacccagctggaatgatgcagagtatgactccaattaatgggcaaaccaaacccaggtgtttttccccttttaaaagcagtccaatggaggacatttttcaaagcctccacttgaatgaagtggtgggtcccgttgacgtgactggcttaatttgcttcttttggttgccagaggctgcatttccatgatatttattattagctcatgtcctgaggtggtcttgcagcaatcaagtgaaaaccagcttgttctctcttcctctttccttcagatcacgcaattaaagattgagaataatccctttgccaaaggatttcggggcagtgatgacatggagctgcacagaatgtcaagaatgcaaaggtaggaaagtggattcctcaactttctcctccccacatacccctcaaattacccaggtaagccagcagcaacccagcacctccctccaccagccttcctgcccgtagaatgccaggcacatggaaatggggagaatgagccccctctgtcccattttctgataaccttcacatgtggttggcgccattgggcaacctggagaatacattttctagtggagagaaggtacgaagagttcggcattctccattctcccagggaacaaaaggcacagctttctcttctttctctgctgtctctctccctgtagggaaaccctttctctttttcttcccataagtcacagccgatgaatgcttttttttttttttggcaacagctcttggtaaatgaaagagaagttaatgacttgatttcctgagggtgaaatacagacaaacttgacaccatgtggtgtccagggcactggaggattggaagctggtgctaaaaattgctcggtatttttacatatcctgtggtcatagttgctgatatgatgaatagaacgggctgtagcaaatgtacatagtgggaatttggtctgatttgaaaggattgtacaagcattgccaattttgtggaacattctctctacctcttgatgtgcttccaaaataacttaccatatggcaagcgaattagaaatacatcttgatccctctgaccaagaaggtttgtgtgtgtgtgttgtgtgtgtgtgtgtgtgtgtgtgtgtgtgttttctttttttctgtttggtgggtttagtgtttcaaaataaaatgagatccttttggatgttttccttatcctttctggaagatgtgaaaagggagagtcaggcagatagacagatatattcattcaaagaaagataagagacctaagaacataaagggagaaagaccttaaatctgtggttttaatattaggtttagaaatacatgcaatggaaaaattgtttttagatagcgggcttatcaggtcaaattttgcaagctttttaaaaaataatgctagcccaggtggcatgttcctgcagccccagctactcagaaggccgaggcaggaggatttcttgaacccaggaatttgaggctgcagtgagctatgatcacactactgcactgcagttgggacaacatagcaagaccctgtctccaaatattaaaaaaaaaaaacaagagaatgaccctgtttccaaacattaaaaaaacaaggagtgtggtacatctgtgcacacattcctgttttcataaattggtttccttcaagattgtggactcacaaggtactttttgtggctaaaataggcaagttctgagtttgttatttaaaatttatttttggttttaagcatctacattttgaaattgattgggccatagggtcagtggaaaagatgacaacaaatatcatgttttagctgaaagaggttcaataattcacggccctgggctcagagtgccaactttctgttcctatcccattctgatggtgatttgccgttaaggtggcttagtcattgccacacaaagtcacctctcagtcctacaggcaaagttcctgctgtgcaggtgggagctgaagggagatcacccattcccacctgcaatcaaagggtttcatcatctcttacttcttccctcctttttacaaggtcaagggcagggggtgaataatagatttaaggtgtgttgaatcatcccttcaaactttaccagttaccacctcctactgattataccttccagcataactcggaattcagcccccttctgccagggtgctaattctagccaccaccagcctcctaactaatggagacccaaattcagttctggtctcctccagggactttctttaggcagccaccaaagagatctttgtaaaacacaaatcaggcaagttctctttgcagtggagaacatgtccaagtctcctgttgccatcactataaggtttggactcttttgcctggttagccatgaccttcccatctggcctggccacccccctaggtttgtccttcaccagtgtccccctaatatgtgtcaatcatgctaaaggaaaggcttcaaacctgtgttctttcctttatttttggcccttcgaacacacatttcgtctgtgtcaaactcttttccctccttctcaccaggccatctcccaaccatcactgagtctccttgtagcttttccttccttcaagaagctttccctggccatagactgtgtggtcagcccatgtctcccccaggacccctcctgggaatcagcccctcaaactttaccagttgccctccaggcttttctgtgtccgacccaggcctggaactttggaagatgattggacagatgacagccagctatgaaagtagagacaggtgggcatgtgcaggtgtgtgagagctcagatgtcagatgtcagtcatcaagggagtcttttctaaaagctcttttttttttttttttttggagacagggtctcactctgtcgctcaggctggagtgcagtggcacgatctcaggtctctgcagccctgacatccacaggctcagatgatcctcccacctcccaagtacctgggactgcaggcatgcactgccatacccaactaaatttgtatgtttttattttattattattacttttttgaggcggaatctccctctgtcatccaggctggagtgcagtggcacgatctccgctcactgcaaccttggcctcccgggttcaagagagtctcctccctcagcctcctgagtagctggaattacaggcgttcaccaccacgcctggctaattttcgtgttttagtagagacggagttcaccatgttggccaggctggtctcaaactcctgacctcaggcaatccacccgcctcggcctcccaaagtgctgggattacaggcgtgagccaccacgcctagcctaaatttgtattttttgtagagacagggtttcaccatgctgcctaggctggcctagaacccctggactcaagtgatctacctgcctcaggctcccaaagtgctgggattacagacattacccacagcccctggccaactctcctaaagttctaaacacatgttcatttgtttgtgtacttacttattgattgattgattgattgagacagggcctcgctctgttgcccaggctggagggcagtggtgcgatcatgactcactgcagcctcaaccttccaggctcaggtggtcttctggcttcagcctcccaaggagctgggtgtccaggcacacagcaccgcatccagctaatttttgtatttttgtagaggcaggatctccccaggttgcccaggctggtcacacaactgtttatatatttaggcagatgactcttctttggcctgaattggctgtcctaaccatctgtcaaggtattgcagattgcttgaggcctggactaggtgtccttgatgggtaggaactttgcagatggaatggaggaaaagtgtggctagtcattggtagaaagtcagtaattgacatgttgagtcaaacctctcagcctaagagccatgtgtgtctttgtggccatgttagcagttgccctggaaaccagagggctgaactaaccactgatgaagttgggggagtagatgaggtcattggccaaggtctctggacatgtccttggggaaggagaaagagtgaagaagagtggttcccacagaaggctttggagtcagacaaacctggggtcaattcttgttctacatttatcagtatgagccctggggtaagtgatttaacctcatggaacctcagtattctcatctgcaggaggggcatagataagtatagcctctactttctagggttcctgtaaaaattatatgagcaaatgcctatagagtgcttgattcctagtctatatgttcagtaaaatttaactaatttggaggaaagctccccagtactcccaattttgcccttgttcagaatttattttgggtcattctcccaacccccaggttgcagtcagtagtgacaagtggggaatatggctctccagagtcagccttgataacagccaggcaggaacggcaggctcactgctaatcttgtaattctgtttcctgtcccctacacacccggtgacagctggctatgggagaaaagcaggagggatgaaatatcctctaattccaacaattggtagaagggagtgaggtgggattacagagagttaagcattaccttgcacttattccacagaaataacttttggatttgcttggcaaatgtctggctgttcccccatctacctcttggcccaactccctgtgtttggaaaacgcagatgatgtcttctttattttccaacattttttaatggtttctagttacaggagcaatcactgcttattataaaaatttgggagctatgggaaagcacaaagcataaagtcatttaaacatcctgtctcaagcagaccaattaaagggtgtgccaagtttatttagaaaggttaatcaatctgtgtcttaaaaaaaatctaatcctaaaaactaatatttccccaaattgaagaacccttagattggtgacaaaggagttttttttttaataaaaactatttatttatttaggacagggtctttccctgccatccaggctggcatgaagtggcacaatcatagctcactgcagcctcgaactcctgagctccagcaatcctcctgccttagcgtctgaagtagctggactacaggtgcataccaccatgcccagctaattttttgtagcgacggaatctcactatgttgcccaggttggtttcaaactcctggtctcaagcaatcctcatgtcctggccttctaaatcatgggaattacaggttttagatggtgcacagacccatggacacatcagtcctgtgatttcatagatgttattgctcagaatgagactgagttctaagaaaggaagaaaagaaggaagcaaggaagggaggggagttaaggctgattaaagaggaaatattaactgaatagcagaacggctcgtatcaaggtttggggaacattgtcaagataatatgcaaagcacagaaatttgagaaacacacataaaagctcaaccacctacaaagaaaggcttgagagtgccattgctgtttgaaaccatctaggccctggttttttatagaacaactctttctttggactttgcttcagtcttcaagatgtattcaaacaagttctgaacttcctaggagccaaaggggctggagctgggactggggcagagtaggctttatggagagggtaaaagtagacctcgtagagagaatgggacctgaatctgttgggaagaagggttttctgggctgaagcaaggaagaagtgggcaagggtctaaaagtctagggggctggagtaggggtcagattctgaagatctctgaaagccagctggagtgactctatgacaggtatgaggagagctgctcctagaagtgtggaattgtagagatagaagggattccaggagacagcatctgatccacctgctctcttttgcagaatgggaaactgaggcccagagactcatttacttattcagcttttgatctgttgatttgtttatgcaactaaaacatttgttaagtgtttgctgtatgccaagcactaggcatacaaggatgaatcaacacacaggggaccagggtccatggatggaaacaggcccaggagctggggtccaggctgccgcgctgagcagctccagggcttttctactcgaccgaggagtgtctgtttcctcatctgtaaaaaggaagtcattacagagcctacctccaggcctgttgcaaggatgaaatgaggtaacgtgtgtgtactgattattattgctgcataacaaatgactcccaagcttaagctgggctggctgggacaacctggcttccaaactatcccatctgttctctgtgtgtgatgttaaatccaggccagccaaagtggctcacctgcgacaactttccccaacaacacattgggagtcttctagcagaggaaggaagtatacacttccacaaagagctcccagaccatcaaagtccccaagttccctacagttgcaatctgctagcccccagtaatgtcccataaatgctgcttgtggtgaaaagaccaggcctttgctggtcgccgttgtgtgcaaggggaagcaggaagcaccagggaggcacttttattttgtctgtgattggtgggtcatgctatttggaaggactcagctgtgcagttcttgctgaccatcagatggtggctgggctaccggtaacggaaggcaggtcaggcaggatgtccagcttggcacactcctgtgacccacagttgatgctgcttttggatgggacctcagctgttgtccactgaaaaatcagaatgtggcctctctagcttggcagactcagggtgttcagactttctcacggaagtggaagccacctggtccttgctgactgcaccttggatgtcaggtagtgtcacttctgctgcattcttttggttgaatgtgactcactcaggtgggttcagattcagggagtttgagaccagcctggacaacatggtgaaaccccgtctctactaaaaatacaaaaaattagctgggtgtggtggtgctcacctgtaatcccagctacttgggagtctgaggtgggagcattgcttgaaccccagaggtagaggttgcagtgagcccagatcgtgccactgcactccagcctgggcaacaagagtgaaactccgtctcgaaaaaaacaaaacaaaacaaacaaaacaaaacagaaaacaggttcaagaagggaggacaagttctctcttctacctagaaggagtgtcaaggaattcgtcgacgcattttaaaactgcctcagcaggcatggaagcacacagcacagtgtctggcccagagggacgctcgatcgctggtaggtgttaagacacggtccatgttctgttgaagccagatgccaggttgacttgcccaaggtcacacagtttggatgaaggggcctgcctggctgcaagcttgctttcttcaggatggagagaaccccctttccactaaactgggcttctgctcatcttcttgtaaccataaaccccagaatatgaacaagcaatagcaaagtccttcatctcggtatttcttagctcacctcacacagaatgaccatgagcaatgactggtcttttcaccataagaagtatttatggagcattatcaggggctaagtagatgatggattgggggacttggttggcctcagagttcttcatggaagaaatgaagctccctttacttccttgctctcttagtgtgctgcagacggcatcaggggcgtggtccctgaacctaaggggtaacttgaggctctacttttggtgactgggatctgagccacccaaccagagagtggatgggaaagtttggagtccaggatgtctcagccagactgaagcccacccatgactcagctccagtttgattattgaaaggactctacacagccacattgggaactgaccaacctcacccgcctctgtgggtgcttatttttaccctctctaccttgttcctgtagggtagggcttctgaaaatgggtgcaagactccttttgaaaatctagttaaagcaagagaccctctgaaagactcacaatatatgaatagagaaaaaaagtcgctaggtgtggtggctcatgtgtgtaatctcagcactttgggaggctgagacaggaggagaattgcttgagatcaggagtttgagaccagccagagcaacgtaggaagatcctgtctctaaaaaaaaagaaaaagaaaaagataaaaaaaaaaaaaaagattaactggacatgatagcctgtgtctatagttgcagttactcttttggctgagacaggaggattgcttgagcccaggagtttgaggcagcagtgagctgtgattatgccactgcattccagcctgagcaacagagcaaaatgctgtctcaattaaaaaaattcaatttcaagggatgtataaggcctaggtctcctaaaaggttaaaattcttctatttgaaccttccctcttctattacttccttcctgattttaaattaattttcagctcttaacctcaaatgatcatttttcaaactgaaggcttagcactcttgtgttctcatgcttgtggttaaaggtaatctgaatgcccaattaatgagaagtggttttcgagacaacattagacaaccttctggagatggcattaactcccctcttagggttgtaatttacctagccacatggcttcctccagggaagcagtgcatttatgtaaaacaagagcggggttgtgtctggggagctgagccagcctaagtgaagctgtaaaattgagatgtttttctgaaaggatctcatcttgggtcatggttatttgtcaaggcatggatgctcagaacccaaccccgccacattcccactttcccactcaggtacccccacccccacctaacccatccccagcatatctgctattcaggaacagggttgggagaaactcactcacccatctgtgtttttcctcatctttaatgaggtataattgacaaaaagtgtatatacttaggttatacaacttaatagtttaatatacgtaaatgtgagataattaccataatcaagctaattaacatattcagcacctcatatagttaccattttattttcttgtgtatatatatattttaatatatatatataaatatttaagatgtaccctcttagttaattttaagtacacaatactgtgctcttaactgtattcacattgctgtacgttagctctccaggaattatgcctcttgaataactgcctcttgaataacaaatgcctttgacctatatctccccattgcccttctccccagctactggcaaccaccattctcctctccactgctacaggtttgactattttagattacacctataagtgagtcatgtcatgttgatctttctgtgtccggcttgtttcacttaacaatgtcctccaggttcattcatgttgtctcaaacgagaggatttccttctttatttttaaggctgaatagtattctagtgtgtgtgtgtgtgtgtatatatatacacaccacattttctttatccattcatccactcatggatactcaggctgattccatatgttggctcttttgaatcgtgctgcaatgatcatgggagtgtagatatctctttaagatactgatttcatttcctttgggtgtatatctagaagagggatatacatatatccctgggtcatatgagagttctatttttctgttatttatatattgttttgttttgagataaggtcttactctgttgcccaggctggagtgcagtgtcatgatcagggctcattacagcttccacttcctgggttcaagcaatcctcccacctcagccatccaagtagctgggactacaggcacgtgccaccatgccttgttaatgtttttcaatttcagtagagacaagaccttgctatgttgctcaggctagtcttgaactcctgagctcaagtgatcctcctgccttggcctcccaaagtgctgggatgacagaacgtgggccactgcacctggctgatagttctatttttaatttttttgggaacctccatactgtgttccatggtggccgcaccaacttgcattcccaccagcagtgtgcaaggattcctttttctccacatccttgccaacatttgttatcttttgtctttttgagaatagccatcctaacaggtgtaaggtgatatatctcatgtggctttgatttgtatttcctcaatgagtaatgaagttgtacatttttattatacctcttatctatttgtatgtcttcttttgagaaatgtctattcaggtcttttgcccattttttaatgggatttttttcaccactattgagttgagttcatccacaattgagcagtgtttctcaaacttttggtagacatcacaattacctggggggcttgttaaaaaagatttctaggtctcactctcagaggtttgagtcagtggcttcagggatgggtcagaaactgcccttcaacagttttctccagtggctctgatggaggtgtcccctggtcacacttgggtaatcccttggttctagagaatgagtgagcactagagaatgcagatgaacacgtgattgtatttctgcaaacaaagcccatgtatgggccattttacacaaaaggcaacccttttctctacttagtactcaactcacactgaacattagaattacctgtagtcctcccctcagtgttctattatgaaaaatcgaaggcgtgtgagaaacatggaagaattgtacgatgagtgcccatgtactcactgcttagagtctacaattaaaattttgctatatatttgctctaccacatatccctccatccactcacctatccatccattcatctagccatccttccgtccctctctccctccctccttctttttattgatgcatttcaaattaaattgcagacatgagtacattttaccccaaacactacagtgtgcacatcattaactaggactcaatttttgttcacactcctgtattttaggttgaatttatatagggtgaaatgtacaaatgttaagtacacctctcactgtttggcacatgcacatacctgtgaaacccaagcccctatccaaatatagaacattcccatcaccccagaaaattctctcatttcctgcccccttgtcactccctgcctccttctcttcaccagaggcaatcaatgtcctgacttttttcactataggttagttttgtctgttatagaatttcatataaataggatcatccagtgtatactctttgtggaagacttctttctcctgggaagcttttaaaaactcccagtgtccatgctgttccccagaactataacatcaaattccctgggggtgagtttgggtgtcaacatatctatttttaatttcccaggtgattatggtatgcagccaagcttgaaaccaactcccctagaggaagttcctcgtctttgtccatccccaccctaagccgtgtcccccaatcacccaactccactaattaacatcctcacattaaaattttattttccaagagacctgctaccttgtagttgttctgaacagggaaggaggcagacttttatattagcacagaaaacatttatcattccttcagaaatagttgctttgggtgactttgccaaggtcatcctcagaagcgaaggtcaccaggaagtccttggcttacttctggatcatcagtggcctccacatgattttccccagaacaaaggatgccccaaggcaatccctttggtacagaaagcagtttgagaaagctgtagcattccagcttccagaaggattgaggccttggaggactccttctcaccaccctacccctgttccaaaatcatgtaaaagaaaagactaaacctaagtcatagttaagctggtttaaatggttaatttacaagactggactaaaatattggctgttcagttcagtactagactatttgatgaattattaccataaattcattaaaagtttagcttgaggctgggtgcggtggctcatgcctataatcctagcactttgggaggccgaggtgggcggatcacaaggtcaggagtttgagaccagcctggccaacatggtgaaaccccgcctcttctaaaaatacaaaaattagctgggcatgatggtgggtgcttgcagtcccagctacttgggaggctgaggcaggagaatcgcttgaacctgagaggcagaggttgcagtgagctgagattgcaccattgcactccagcctgggcgacagagcgagactgtctcaaaaacaaacacaaacaaacaaactttagcttgaattgtccttttatgtctgtagttttacaaagtttagcttgaattgtcctttgttgtctgtagttttacatctagcttttacccgcagaatccacacctgccctgtgagataggcctcttgttctccgttatgcaaacagggaaactgagacaaagggtaatgtcatgaattgcccaggacttttctccatgatttccgaaccatctctatagtttgagtcaaaaccgttttttgaatcacagaccctttttgagtagccaatgcaaatgtgaacctcttcctagaaaaagtgatcagctctaaatatttgacatttttgggtattcatacccatttgaagcccttgctgggtaagaacctctgctccaaaatataataatgtatatttacaaaatagtgtttattgagcaatgtgtccccagtgtgtgtgtgtgtgtgtgtgtgtgtgtgtgtgtgtgtgtgtatgtatatatattcgctaagcctttccatgcatcatttcattttataaccccaaagaggtggctattttattatccccattttatagacagaagactgaggcttgggtaaaggaagaaactagccagcaatggagtggtctagttcgtgcctggatactgaaggaaggcacattcacctggcctgacatcggagcctgagcttgatgctaccactctgatactatattatctacagatttaacaagtgggacccaaggccccaaaccaaaatttttacaagtggtgggtacttaaggccagggagagaagtgcctttgagtttcttggcacccctcaaatcatatagccctggttgagtcaacaatgggaaatttaggccttataaggtggctcatgtctattatcccagtgctttgggaggcagaggggaggatcacttgaggccagatcaaaaccaacctgggcaatatagcaagaccccatctctaaaaaaaaaaaaaatacaactattggctgggtgtggtggcacatgcctacagttccagctacctgggaggctgaagcaggaggaccccttgagcccaggagcctgaagtcaccgtgagctatgttcatgccacctcactccagcctggacaacagagtgagagtttgtcttaaaaacaaaagaaaaaaaccgacaatgggaaagttttataacctctttgtgccctcacccccattcttttttgaaatttgtataaatttagagagtacaagggtagcttttatacctggatctattgcatagtggtgaagtcgggcttttagtgtaagtatcactttaatagtgtacattgtatccattaagtaatttctcatccctcacccacctcccacccgtcggagcctccaatgtctgttattccatgctctatgtccacgcccaggttgtacacattctttagctccacttataagtgagaacattgtgtccccttattctcatcagcaacatggtacccagcgcccttctcctgctggtgtagtgtaaactgagtaagcactttgcagacttgaagaagccagtgattatttactatttgcactaggcgaaatccagccttgggtgtgccctctgcagtccctgccgtgtccgtgcatgttagatcagaacaacttcctcaagtgtattagaattagaatgttaagaaatcaagaaagctctcaaggggtgatgtggccccctttttaattttaatcacagattaaaatgctatcgagaagaggaatttgctccaagagaagagggatttcacagtccctcgccttgccccagtgcactgctttagttgtttgaaaaaggctgccagaaattgggtaaggatcaccaggaaaaaaaaaaaaaaaaaaacacaaaaatctgaacatgccagcgccccctgccacctgctcccatgaaaaggccaattcagtcggctgtagtggaaaacgttctcccgggtgttcattagctggagggaggctgaggatgcagtttggccgtggatttcaatattcccttgtaacgttttacaacccagacccagcgacaatggcgtcattcattgcactcgctcacgtggaacagaacatgagagaagggcagagctggggagaagctggtctgtgggcgctgatacccaaggccagctgaggtactcaggacccccagctcgtgttggggtcgggggtcccagactcttgtcagagcttgtccatgggatgcaggtgtagctgcttgatacagcagagagcagtgagatttgactgttgcaaactaaagtttctgcaaagagtaggatagatcagtagatcttgatattgcccgggtggagccaatatccaattctctcattaccagcatgctttataaagtgggatttgccaagtagttggtatggaggtaacaattgcttattattaagcattagttaggtggctgatataatgggcttatggggacttttatcactcatccccgttccaccattccccttgatatagggacttggaaggaagggcgggaggggtatgagggatagaaggctatatattgggtacagtgtacactgctcgggtgatgggttcatgaaaatctcagaagtcaccactaaagaactaatccacgtaaccaaacactacctattcccccaaaacaaaaaaatttttaaaatgtcatgtgaaaaaaataaacatgataactgataggaaaaaaaaaggttaaatgaggtcataagtgtggggctttaatctcacaggatggtggccatataaaaaagaggaagatagatagatagagagagagagagagagagagagagggagagatcatcccccactctaaccctccctgcctggcatgtgaggacactgagggaaggcggccatcagaagcgaggaagacaggcatcacccgaaactgaccatgctagcacccacatctccagaactatgagaaaatacatttctgtgtgtgtgctttttttaaagtattaggtggcgtgagttttggaataggattgaccctgggtgagactcagctttgcctcttagctgtgtggtctgggacaagtcacttgacctctctgtacctgccttttcttttctttcttttcttttttcttttctcttttcttttcttttctttcttttcttttcttttcttttctttcttttcttttcttttcttttcttttcttttcttttcttttcttttcttttcttttctgagacagagtttcactcttgtcatccaggctggagtgcaatggtgctatcttggctcattgcaacctccacctcccaggttcaagtgattgtcctacctcagcctcccaagtacatgcccagctaatttttgtatttttagtagagacaaggtttcgtcatgttgaccagactggtcttgaactcctgatctcaagtgatctgcctgcctcagcctcccaaagtgctggaattacaggtgtgagccaccgtgcctggcccatctgcattttcttatctctaatgtaaatgtaactgtacctgtgaaatgaggttcttgccaggatcaaatcaggataagcatataagtcaagcagtacggtggctggaacattaggaggcattgaagaacaatgtagatgagaatgatgatgatgatgattaaaaaaagagcaggctccttttgctgcctgtatttctagagacagaagggcttttcaactttcactttaattctcttgtgtccttgcttcttcatggatgttcttaagctgtagaagaaaatagttttatcttctcatctggaggactttagagatttctgtcatactaaccacgtctctttggttgaccgttcctttgatccatggatgagctctgtgaaaattgccccgctgttgtttgattctaacattttctttcctttgcatgtgtaattctataatgattgagaagtcacttccccattccatgcccatattttgacacttgtcagaggggtttggggacatcgtatttcaggcattaacagagatgttcacgatcggtgttggggatgatgtttcaggctctttagagggaaacaagctgtgagggacaagtggttattgggatgatattgcttttcccacttctgtgttagtaatcaaaagcaggacttggcctttccagagagcaattttgcaatttggctgtactggaacggagaattccacggagtccattgatacattctcttgtaaactctctcagccaacattttttggaggttattttctttaattaaaaagaaaaactgttcctattaaaaatataaaaccaaaagagatttcccccttcctcttggagctctgacagcaaaatattggaactaaatagatctaaatagaattgtcggcaagttttgacaacttttataatgttttattgttattataatttttcttctttttctttttttcttttttttttccattacgtagcttgaaccacaaagcaagagctgtaaagctaattccattcccttcagcctcctggccccagggggagattctgactggtgcggctgctcggatggctccagctttggttctgagatggcacagggaagctgggctaggagacccctgggtgtcctgagggtgtctgtagactcatggaaacttggcagatgctctgtgttcctgcctggccactctggtgtgctttcacatgacaaacaaaggcagggacatagggtggagatgttcacacacttgagggggtagaagtagaaagagtcttgtaccccaaaaccctgctcccctaaaagcatattgtgttctaaaaattgaaagacatcattaggatacaatgcaaaagttatgaggaaatgattggattagaattctagttgtgtctctttctaactctgtgatcttgaacaagttgcttcatctccctgggcctcaacttcctcatctgtaaaatgggatcaaagataatacctatcacatagagtcatagaaaggatgaaatggacgaattcaagatccttcaaaatgcgttacgtgtagctctttgcgcatgatattatttcaggtatactctttaattttaatagttaagcattgattgattgattgattgattgattgattgagacagggtttcactctgtcacccaggctggagtgcaatggtgcagtcatagctcactgcagcctcaaactcctgggctcaagcaatcctcttgcctcagcctcctgagttgctatgaccataggcacataaacattcgtcttaattgcattaaaataactataattagcaccacaagcctgtaatttcacagatatgatcacttatagtgaagcttaacttatttagataaatgattaatttttaaaatgtcataagttaaagaatagatggctgtatgtcatggtgaaaattgtgtctgactgaagtttgggatttactgacacatgctccttctaggataggggttcttaaactgtttgatgccatgggcctctctggcagtgtgttgaagcctatgaatcatctctaagaataatatgattaaatgcatgaaatagaatacataggttacaagagaagccaattatatttgaaatatagttaccaaaatatgttttaaatggctgtttagcaatatatgcagtttgtaaatgccatgcccaagattccctatccccatcctaaatgctggatatgggatgttaggggtcaagctcttcttctctcacatacttggatatttctctctttgtcccttctatcttgaagcacccccacccccaccttctctctactcctctgcaaccttccacatcccatccattccccacctctctcatttcctttgagcctcctgctgctgcacagcacgactttccttcttcccaggagaggtttctactgagtccttctgaggaaaaaaaatgggaacacctggtatgaaatctgaaggtaagggaatgtggaggaccagtcctaagagtgtgaggggccagattttgagcacactgagggatgctatacctatgatgtcatggaatttttattatgcttactttgcctgtgtgagccctgaagctcaggggagggttgtgtgtcagatggacacacagcctgtaagggatagggatggggcctgaattgggagctgcgtaatcttagatcccatgctgattttttcttttcttttctttctttccttttttgtttcttttttctttctttctttttaaatcttctatgtccttgttcctccttctttctcattttctttccctctcttttttccctccctctattctctctgcccaaaacaataacagtaatgacgatggttgccatttgttgagcatttactctgtgccatgtacctttctgagtcttttcatggttaactcattaacccgtttcttctatcaacagccctttgaactggggacattcattatccctactttacagatgggaaaactaaggtatggagaagttaagtatatcagtggccacaaggacagaagctcaggaggaaattctgacactagcagcaatctatccagatgagagtaacttaggattatacctgaccttcctaggttgtcagctaccagtttttactaactttgggcaatgacctgagccccaccttaaagatggacacccacaggttaagtctaaataaatactcagattaactagctttcaaattagggaatttaaagacatacatagactaaattgacatatttcaaaataccatgtgtgtttattgattgttaaaaggggttcttaactgggggtgtttatttacttttctgctgaggtatagaactgttggtaaatctacttgcctaatgtataaggcatgaaaaattagtacccaaatatacatttgtgaaatatgatggacatgaatataactggatcattttattcatcaaagacctcttttttttccttattctgtgacttttctggtggattctctcacacctggttcagccactcaggaaatctgtatcagggcactgataggcgttatctcccatcttttctctttcagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaaggtgagtgtgatcacccctggtcaatttgctttctttcttaccttttcctttccttgggttgggggtgagggggtgaggagtattcatttatttactttatttatttaaaaatgtaaacaacacaaaaatatatggagataagaaatttaaaccaaacagctaaaacaaaaagttcccttgacatgttcctacccccagttccagcccctcctttggagaaagcttatttgaaatgttcagacctattgtattcatttatgcacacatacacgtggcgagtgcagagaaagaactagatttatttttacttttttttttcttttttttttttttttgagacaggatcttgctctatcacccaggctggagtgcagtggtgtagtcatggctcactgcagcctcaaccacctgggcttaagtgatcctttcacatcagcctccctagtagctgggactataggcatgcgttcacacactgtactaaatttttgttgttgttgtagagacagggtctcactgtgttgcccaggcttgtctaaacctcctgggctcaagtgacccacctgccttggcttcccaaagtgctgggattacatgcctgagccaccacacccaaaattttttttaaaaacttttaatatagatgaaatcacactgtatgtattttgcaacttgctgttttttttcttttaaactttagaatgtgttttgggtatctttttatgaacctagactgccttattttatttttaactgctaaggaggaagaattgactggaaaggataaaatggagtttattttgtcactccctctggtaggcagggaggttgcttgagtggtccctgatggtattacaagccgtgatgcaggaaaaccccttgtgactatcaatgcttctctggcatatgtgtcagtgtttctcccaggtggattttgaactctttttttttttttcctgatcaaaaccaacacacacacacacacacacacacacatcacaaatgattttccccgtctcatcccccatttaaatctactaagctgaggcattccgcagttttctttgccacatgagaaataaatggcttttttttttttctaagtcatccaagtccaaaggggctaagctaaagaaagaattttctggtggcccttcttgtgagccagaatagaagtgtttggcacaggtggtgtggtggagttcagctcgatagaaccattgcttggtgtgagctgtagatggtatggtggggagactgcagcctttggggacagagagatgcgggtttgaatctcatctctgctccctgcttcttgtgtgacctcactcaggtgttctagcctctcctagcctcagtttctcactttgtaaatgatatgtttcctaaagcatctgatagttagcaagtacgcagtaggtggcagccatgattgggtatgtggcagatatcgctccagaaggtgattcccaggaggaatctgcctcttgtctttggactggcattaatttaatcagtcttcccagagaagactgcctctctaggtgagagcttgagaagacagatacagaagggatggggtaggctaaagtttacatctgtggtctgtagaatcaatcaggatgaagttcacctttgcaatttaaaaattttcataagtagtgacaagttgcttaacctttccaagcctcatttttaaaaatctgtaaatatgggctcagggtacgacttgtctcataggcttggtgcagagatgtcaaaaaatcatacacatcatatgttatctcagggttgactcagaaagtagtagctgttttgctctaaaagacactaattttaatctacaaagtggcctgttgaacctcacagcctcagtggtcaacacaagcctttgtgaatccagtgcccagtgcctagccctttaggaaaaaataactcgctaacaaccaatgggaatggatgctttggtagctttttctggagctggggttacatgaggaaagtaacatagtttgactatttgacatttaccaatcttgcgttttaaaggagggaagagctgtcattggtatttacatggggctaggagctgacctggatgaggcctgacttccagacttacctgaagccaatccaaactccttgaatctcaaaggcctgaacaatatcactccaacaggccccctggcgtgactcccggcacgtctgctgccggatggactggagaccagatgcctgcaaatatgtctgcctctttaggcatgagcaggaggttaagaatgtcctatgggacacaggtccctgaatagagattctgttttatattatatttaagggtgcccttcctaagtcccagatcaagctttttcgacaacactatggagtagatgctattattaacccactttatcaatggggaaactgaggctcagaaaggttccaaacaaaaactgccagtggttcttgaaccccagcctggtctgcagattctatacgtgtgcatttcaccactactctataccgtcttggttacctttgctcatctgctacaatctcaaaatttcattttccactgaagatctgtctttgagactgggtcaaacatgctgattaagagctcaccaggtttgaattcgggagctctaatcgattaaattaatgccagaccaaaagacaggcaggaagaagttaaaaaggatcatggtgctttttaggttcaatatttacagcagcatccttataaatgcatccctgaaggatgcggcagggaggctttgaatgcacggttcacaaacctcttaggttatgacttgactttcatggactgtttgttggatccttggatgagcttaaaatcaacttggagtggccactggggaagctggagttgggggctgatccactgtagtaatactcacagttgacgacacttggcagctgtgtgcccaggggcaagttgttttacctttctgggcctcaactatcttttgtgcaaaatgaggataacaatagcacctgcttgatacggttgtgatgaggggaaatgagatcatccacagaaagcacctagaacagtgtctggcacctacaagtgctcaatgaacatgtgcttgccacaggcctgcccttgtgaagctcatacggttgcaagcaggttggacattatacaagtaattataaattgcttaattgaaattgtgaagcctggcactgtggctcacacctgtaatctcagcattttgggaggctgaggctggaggattgcttgagtccaagagttgggactagcctgggcaacatagtaagactccatctctacaaaaaataaaaaattagtctggcatgttggcacatgccagtggtcctagccaacccaggaggctgagatgggaggattgcttgagcccaggagttcgaggctgcagtgagctgtgattgcaccactgcactccagcctgtgtgacagagagagaccctgtctcaaaaaataaataaataaaataaaataaatgattgaatgctataaaggagatatgcaaagtgttaaggaatatcaaactggagtgtcagtctagggtaggcaatcagggaagcattgaggctgagatcagaggagactgagtgctggataggagaagggggaggtgtgagggtatccacacatagaggaaagcatgcatgaagccccttggctgagggagagcctgccccctggggagtgaacagaaggctgagatgttggcactcaaggcaagggcaaagtggtgggggatgagggctagaggggaaggcagggaccagtgagatgccagcctgtataagccattttaatgaaagatgtcagattttatcctaccaccagtgcacgtccattggagggatttaaatttgtgagtaacatgcctaagttctttatttggaagcagtcactgtgctatgatagcacaggactatttagttggcaccagagacccattgaaaggctgtcatggggtctgaaacaggagatggtggctccgaccagggtgtggggagaagctggagatgtgggtggaatcaggccttagtggctggttggcgataacaaggtgaagaattaccccacttctttgtggatttggaaaccaacactgaggaacttacccaaagtcactcagctcgtgagtggcccagcttgagatgtatactgaggcctgtgggctcagggtgaatggggtatgcaccctggagaaatcctttcacctttccagaaactctgcccttctcacctccctccacccccaaaagggagctcccagtgacagggaacattccaaccgagggctctctgtcctgcctaggagacaacaaatagcaattcatcatcagcctccacactgtaaagtgataaggaatcagccgaggtttccttccagttgggattctcattaagtgataactccatgggtggttttccccctggcccctgcctgccccactatctgacttcccctcattgtctgtctcctttccaatgagcccaggagtcaggcccaatgaaatgtcacagggccaggcaggccggagggctccttgtgtttggaaccggctgtctccaaactatctctcccgatggactgagccaaaaaagctgggaaggtcttttatcaatgccactcaatcaaatccaggaccccagggcctgggagagcacttgtctgtctttctccctctcacccctgactctcacccccactcgcattagaaactaaaagcaacccaaataaagattctagcaaagccatgagctgaatcagatattcaaaggaaagttagagattgagaggggaaggggaattcgatatggaaaagggctttgcagggtgcattttctgagtgctatgttttaaaatgcgatttcacatccattcctttgctgattctccagttccctgcagcagtctttggactaggggagatgccacccatctctattttgcagggatctaatggaggaccaagagacagggttagattttaagcttatgtggctgatgattggcagatctgggatggatgcatcagattaatctttatttattgagcacttaatgtataatggacactgtgctaggtgcttgggataagtggaggacatggtggaaaaggctcccgctctcaagaaacttgaattcttactggatgagacatataataagccagtaagtaaatttattggtttcaggtagtgactaggtgatgtttcaaactgagtcttttgatttctcgttgagaatcttcgcacaataccattccaacccttcctactttatgctaagagcatggggacaccaaaaacaaataacaacaacaacaaaaacaacaacaacaaaaagtcatccacccactcatccacccacccaccaatccatccacccaccattcacccatccacccacccatccacccactcactcattcatccatccacccatccatcactcatctatctatccactcactcatccatccacccactcatccatctacccactcatccatccagccatcaccccacctatccacttatccatccacccacttatccatccccccacccatctatcaacccatccatccacctacccaaccactcactcatccatcaacccacccatccattcacccatctacccacccacccatccatgcatccatccacccatccaaccacccatccatccacccactcatccaccaatcctcccactcattcattcatccatccatccacccacccacccacccatacatctatcctcccatccatccatctactcatccacccactcatccataagagtcaaggtttgctaccttttcatgttggctgagcatgtagggttgcgtgaaatggaaagcctggggccatctgtcagaatgagcactgctttgtgagtcagaagacctgaattatagccaccttcccaacttgctgaaggtcactcagctagaaagattactactctgagtttcagggtctctgtctgggaagactcgccaatggttcttcatctgaatgaactgaattggcaagagaaatgacccatttgggaatagtgaaaatatttgctcaataggattagtatttaaaagcactctgtgagctttccagctctgtaatctacccaaatactattaagtatgggacaactttcagaaagctatctatccagtcttccaaaagagaaagagggaaaagagaatggacccaggtcatttggacagacaagatttgaatgctttatgtgcaaggaagataaaaactcaactgccctcattattacctcaattaaatctcataaaaagttcaggtattatctccatttacaatcaagaactgagattggaatgacctggtgattcatccagtcacatggcgagcgagcattggagctgtaactctgtgccttaatatctgtgccttggatgcattactaaattcactttatccggaatcaaaaatatctagaaaaatccaaagtactagggttttctacagtgccatgccataatgagtggtcagaatcaggaagaatttactgttacctaagagactcatttcggtttaggatagttgcaatataactgaccactcttaatatgcaactttctgaagccgagttgtggactcatctcatcagaagacttgatacttaagtatagcccatttaccaaccctgaaagttaatcatgacttggctggagataggtctttgctgttgaacagttattgggctctcaaagaagagaaaaaagaaagaaactgagccataaccaaaataaacacagagattacatccagagcatttatcatgactgacctgaaatttggatccttgagttggaatttctttacaatgtgatgaggcctgagaggaatttgagaatgttcaggacctgctttcatcaataagccaagattgagtttttcttagtgctctgcattagatctttggggtattaaagactggaatgtataattttacgattttccaaaatgtgttccggccgttttcttattattcttccttttttacttgtaacaaatctggaaggggatcagaaacttgaaaatagttagtttgccttgtttttttttcctcttgctaagggtgccctgcagctgtactttctattattgaaaagggtaacaccctggttaattggaaaacccaaaggttatgattccagcaacaatggaaacactcaggtttatgaatctgggggaaggaaggaagaattgaaggaaaggaatcaagggaggaggtggtgaggacaaaaagaagctgagtatagcaatgtcttcaagcctccaaacaaacaaacaaacaaacaaacaaacaaaaaaaaccccgcacagttaaaaggtgaaaaatgtggccgttcattcatctggatgttttcaaacatctgcatggttggcatgatgtagatagaacacctggaagagtgtgtttttcttttttttttatttttggtacaaatttttttggtatcctataagtcccatatgtggcccagaaagagtctagtggaaataagtttacttgctgttaagtgggcacaaccctaagagatatgttttgtttgtggatacttttggcttatctgtgggtgtcacttggacattgatacaaatggagctgattggtggaatccaaacccaagctactctacctgggtttgggagctattttacaaaccagtccaaagccaaaggatttagtcttgagtcaatggcttacttgtgtctttatatctgaggaccacctctcagtcacagagtgtcagcctccctcacttactgctcatggtaggatagactgggattgaggacatgcaccaaaaacgggatcatgttcaccactctatctccagcacctggcacaatacctagcactttggagcagctcagtaattatctgctgtatgattgcatgagtggcactgggtattagaaatctagagagttggaagcaaggtgtgtaggcaaagtcaatccaatctggcttagattccagcctctgttccttctcagccatgtgaccttgggcaagtcacttctctgagctttagtttctgcctttatgagacaggcattacagcagacaccttgaggaattactgtgagatgaagagtaaggtcatgtagtaggtactcaataaataatagctctgatcatttcctctcgttatttagttcagcattctgttttcatggccatgagccatcacagtgagttgcatggatgccccagtgtttcatttttcttcacttctccaaagacagacataatttcttaacatttattgactagaaagagacagaaagatgaggaaagagaattttcagtttggaaggtaaaatttcagataagtaatgagtctgtgttgaggtttatactttggtagatatccccaagtattgcttcccctgaagggaatactttgagggtattattgtgaattatgtctgccatgagcctgactggtggtgttagccctgcaacaagagctgttcatgttgacggaaatcaggagactttacatgctcaatcttagttcttagctacccagtaaggtaagtattactcactttgattcagagatgatgatgagtctctgagcgtagatgccctgctggtatcacgcagatattaagtaaaggagcctgattcaaatccagacatgtctaggcttcttaacctggggtctgggttttagggagtctttgaaccccctgaaattgtatgcaaagccttgtatgcacatgcagttttcaaaacattgtgtttcaatgcagttttctaggaaagagcccagcactttttcttgttttcaaaggggccagtggccccgaagtggtgaaaggagaccccctttcagagacaaaactatctccacttccctacactaggaaatgactagtacacagggaagggaagggacttgctcagcaggaaacagcaacacattaacttgtaccaacttaacaaatactaactaggcacatgcttacataaggaatcaggaaagaatttgaacattcattcaagctccctcccactcatccatgcatccatgcatccatgcatccatccatccatccatccatccatccatccatccatcgtacaaatatttattgcatgctttctctatgtatcaagacagtgaaaaacaagggctttgtggtcagactacttggattctaatcctggctctactgtttatcagccatgtgaaaccttgggcaagtttcttaacctccgtgagtcctttttctctcatctgtaagatgaggataatagtaaaacccacctggtagggttgttgtgattaaatgtgttacttcctggagagtgcttagaatcgtgctacgcagagtacacactgtatatgtttgttttgacttattgttgatgctgttgttaatagtaggtgtttactaggttctgggaatatagtcatggataaggcagaaaatgtcctgcttttatgaaatttacatgctggagaagaggaaagataataataattgctatttatttatttttgagatggggggtctcactatgttgcccaggctggtctcaaactcctgggctcaagtgatcctttttccttggcctcccgagcagctggaactataggcgtgcacaactgcacctggttagttgctatttattgagtgtttctgggctctggactaagtgcttcatgtattttcccatttaattctcaacactgccctttgtaggaagtgctatttcctaccctttccatcttacagatgaagaagctgaacccagaaaggtcaaactgtttgcatagaactccatagcccaaggtcttaaccattacaatccaaccccctttttttgtattcagaatggcggttagggctaacagtctctcaggacttattcttcagtactttggccaaataactgtctccacttttagctgcctggtgcctgctcctggcctcactgctgtctctcctgtcttcacagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacggacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttccctagtgcgtagttggagtctgtccctgtcttggtgttaatgttgacattgttatataataaatgataatatatttttttctttcaattttcttaatgggacccagtcccttatttggggggaggtctgaggcaagtatatttcaaaatatgtacttgcgggattcccttcaagtaaaccatccctgaaacctaaattcacgtttccccttgactaagaaaagcacctacctctgccatgtgatgtttctgaaaagcctctgtatgtccccatttgctttggttttgtcctgccttctccaatatcacgtgctcagttttgcctctacttacccatggagtcaggataacactgacgctccctggcatcctatcttattcagccctaccatcttgccagctctgtctttccagctgtctgtcgctaaaacgtggcctatagcttcccttccggaaagcttgctttgaaaaacttaaaaagcccccgtttacatgtaggcaggactgtgataacagtgcaagctctgtgttgacaagagttgtggacaaaaagccaaaataaatattcttcctgattaaaaaaattttttttgaaaaaaacaaggccagccccaaccttccaaacctccatcaccaacaacccaaactggatgtcaagcaaaatgcacaattcctacagaagaggcaagacacagtcaccaatgatatctcgccaaagaaaccacgcccacaccaatgccaacacaaaactgtgtttactgaaagccgaaaacagtattaaaaaaagtgtgtaagtaaagtgttatggtagggttcttcagatgtaatattttactggtactatttatttataaataggaattctaattaagtaataacatgaaatgaaacccagcataggagctggccaagagcttttaattttattgatactcaaaaccaagtttgtgtttttttgtttttttttgtttttttcctctttcgaatgtgctttgctttttttgattaaaaagaattttttttttccttttttataaacagaccctaataaagagaacagggtaagatgtgaggctgagtgtgtttaagtacgtgagagagtgtgagtgtgtttgtaagtgagtgtccctatgcgattatgtctctttacgttgctaaggggggagggtgaggattaagtactcgtgccttatatttgtgtgccaattaatgcctaataaataccatgtgcttaaacaagta

SEQ ID NO: 47 - DNA, 53811 bp, Sus scrofa
tttctaaactcttcacctgaacaaccccttactagccaggcgtcactcaccggcttccacgctggaaagaagaggtgggatttttggaggtgagtgtcgccctggagaattctggggatgaggggtaaaggattctcttaggacttgcctgcccactgcctcctcgctttccgtctcaactcagccctgctggatccccccctcccccgccccttgctacttttctctgtgaaataatgcactctcttgcttgcattttgccttccagtgtcacctggcaagaggagattcccccttgaggtttcaaaatccctggttcgcttggtggcccgcagtatctgcacttcacgagctaagcgaatctggccaggcagttacttgggggagtagagattctccctctccagaggggcctgcagattatttatgggaatttattttatccgcaaatctctgagaatttaaagggattggagagcgctttctggatttccccttccttttgcccgagatgcagcctcatcctgaagccatgtttgttttctgtctttggccgggggtcgccccttgagcgagcccaaagtcctcggagctgacattttggaagggtgagggtgttttcacaaataaataaactgtcttggcaaaaggctgtttgaaagcaaacctggaaggtggagtgagaactgcagcaaatgctccagctggttttctccctggttgtcccacttttagggttggacgatccactctagaattttgcagcgatgtgtcaggcctgccttgggattttagttccaagggcctgagaggattacaccgaggcggcctcagatctccagggcagttctcttccttctgttcctctccccagaccttggcttgcaggcctgaatctctaggcagagccccagaaaagaaccgggtgaaggagacgtgggtgagaaacagaacaggaaccctgacatttgttccaagcactaattcttggttttccaaactgggtctgctcaggctaagacctactgactgtgtttacgcttctattgacctcttcaactcgaccctcaaaataatacatttcagagaggaggagggagggagtggagatgaaaacctgagccagcccccattgactgtttgattattttaataatactgggcactgccttgtgtacacctccagccagggaggtctggtggccctgggagggtgggggtgggagcgcagggcgatttcttggcatctttgatctcggctcccatcccaaggcaccttcaccctgccttcaccctggagtcaccgagagtcagggtgatgagtggggagggggggtgatgtcagggcagctagcagcagcaggctgggccaggcggggtcaggcagctctccgtcttgaggtcagcggtggagggagaacgctggcaaggctgcagaggaggctgctggtggcgtgtgtgcgtgcactcctagtgcgttcaggctccgttctctgcacggcccgtgtcaccgtgattacttcccgggcagaagccgaccggggtttgctatgatttgtgcgggattttttgcagccaccgagcctcgctccgagaagcagagatggatggaggttgggaagggggtggagaggagggggtgatctcgaggtctgggtttgagagtcctgtggtgatttgagtgttcgggaaatctaatggaaaaggtggttgggggagggagtgggaagggactgggaggagggagggagagagagagggggagagagagagggagggagagggagagggaggcagggaatgtgcagtgggagctagctggataggcattttcagtactttgtaagcatcaaggcagcccagcgtcactgacctcagctgagttggcttgtatttctgagagagagagagagagagagagagagagagagaccgacttacctcggattccggaactctaaccccgaaagctgcgctcagaaaggacttccaccattctcagggctctctcttctctccctccctggggtgcaagggagaagctgggcactgagatcatactgctgggggtgctcacagaggctgctgttttgcgtttttcggagcccttctggcgcctgacaacttgaagtctagagagagagcgggcgcaaagcggaggaggtgtgtggcggctgtgggtagtcgctaccaaggctcccccggtgggtgctcctttgtaggcagcgctagccgccggtctggggaagcagccccccgagtaaacccccggagccaccatgcccgcgcccccgcctcgccgccggcttccctgctaggagcaagaaggcgtgcggtgaatgcaccagcttcgccgccgagcgaggtaactgttccgtagatggcccgggaggctcgggagggagccggctggccgagtcggcccggggaggcgcggaaggctgcactccagccttgtccgggattctccaaggctcgactcgcggagattttgcgcggcccggggctgcccggcgcggggagccgaggaggcggcccgcgcccgcgggagccggcgcggaggtttgcaggacgcgcggcctggttctgtcaaaccgcatctcgttcggctccctccagccccgagctctcgggacccggctcggggtgggattgtcccctcggccggcggtgaatgggagcgcacgtgggggacgccagccccgctttcttttgttgtgagcaggcttcggggctcctgttgccgcctcccccgaaccccaagggcgtggtgaaggaggcctcggaccccatttctgggtcttcagccgctgcagaccagggtgggaaccagccttttggtgtagcagctgctaagatgctggggggggggtggtggcatttcttgtgcctccttcccagtctttccgggtttggagagaggaaatccttacttgtgaacgtagaggagatcagagcagaaggcaagctcctccggggttgaagcgtgctgcaactgttatttccagtgttccaacctcacatgtccataaacccgggccattgcacgcgttgtgttggacccccgtggacttcagtggccggttccacaccagaagcccaggatttacctgggaatcactctgtggccactaacctagagtttgggcctgtagttccaccgagccaggcctggctgaagctcgcagaatctccccttggtgaggccgctcaacaaaacccccctctgtagctagagagcagagaaaaaaggagaatgcaccccaggccagaggctgaatgctggcctcaggcacccagcacctcgcctccctcccagctgctgctcggcttgctttcttgtccctttctgtttggctactttttatttctcaagttgcttatggtgtgtgcgatgggggggagaggactcttaatattaaaggacttttaattttaaggcctgtagctgataaaagatgaacgtgaattctcagacctggtctctgggtctgcaaatctttcacctcctatgtttttggttttgcaagaggcgggttacttcaggcattttgcctcctgcagaaaactatttctgttgccagatttaataaacagggctctgctggctcctataatttgatgaaggagaaaaaattctcagaagggcactaggtttgtgttttgttttgtttttggttcgtacccaatggcttccaaaaatacccaggccttatctttattggctcttccagaagtccagacaaatttgacgggcagctcacttatcagggggagcctgcgcaggggagatgcgggcctcccctcctcccggtctgacgcgggtctttcgcaagaggtggtgcgtggtcataaagtaatagtaatgataataataataggaccttctgcagcctccttcagcagggaaaggaggtgctggtagctggaaactgctggtggaagcctagtaactgctccctcctgtcaccagaactgtgtttccaaccttctcttttttctctctctctgcaccccctcccatctgtctttctctttccttcttgtccttagagcaggacccagagcggtcacagggccctgggctcaccatggccgacggagacgagggctttggcctggctcacacacccctggaaccagattcaaaggatctaccctgtgactcaaaacccgagagtgggctaggggcccccagcaagtccccgtcgtccccgcaggccgccttcacccagcaggtaagaagaccagagcctctcttttaggtgcttgggggagcccagggcttgtaattgtcccttttcttttttattcctcctcaatcccacctttctctgcgtgcctccctaactgccaggatactctgattcactttattgtgaagatgaatctttctggccagaggacctttgaaatacattgaagttgttaggggagccttaatgatctgactctttggggccagtgaacaatggcccagatcgttcctttcctgctgcactaggtgtaaactcggcctgaacgcctcattaagggctgggtcagcggccgcttcaggccagtatgagcgatggcttgacccctcttcagatctttcgtagccttcgcctccgcccgcctcctccgtgccgccgcccagccccgtgcgcagccccatttgtctggcgggccggagcctggagggctggtgcagccggaccggcgggtggcgaggagtgcgcagggcttggctgccagggtgcgggcagccgcgggctcgcctggctggaagctggccttggccgacgatgaaccctcgcctctcgctctgcgcccttcaccagggtgccctgggcgattaaggcatcgtctgaagaagcttgatgattttaaaatagggtgtcgggtggttggaagcggggtgtcttggccaaaagagagggttgcgcgtagctaaaagccgtctatgggatttcgatgtccttcctggcttttcattgcttctctcctttgcccttcacgtctcagaaagatgcgagtatatttatagagaagtggctagcagtgggcccgcagtttcagaaactcagaggttttctttcacagaaaaacgtatctacttattcgacgtctccaaattattgcaaaacgaaaactttgcatataattttttggccttggctttgtaaaataacttatagttgaaagtggaaatgttaaatcgctgtgcccataatcagaatagcttgacgtgaacgaagctcgatgtgaggagggcctaggagttgcgttaatatagacatttgtgaattcacttttgttcgggactgggggaaattattctaatatggaaacattaaaaaaaattaaaactgcacctaggtctatataggcaatgccatggtgagaataaacatgcatgtgtacagtgtttgcacatctctaggttttcgtgtggggacatattgatgtctacctaagaatatcctgactggtttttttttttttttttgagattgaggttgtcttttttttgtttgtttcttttttcttttagctgcctcttggctaaatcagattaagattggtcccattttttctcagccccatcctccctatgcagattctggaacaccctgatggttgaggttttccctagccttttgttggcattcggagacagctctgcattgtacgtgtggggggttaagacctctctccgaccaagcatacagagggattcccgggcaagagctatgggtgcttcagagcccagatgctgcagcagtgaactgggggcagttttcaggctatgagcccactggctcctggcggaaggaggagagatctctctgtgttttcggggagtttgaagaaggaaggctcattgcctcgagggcttatctgtgtgactcttctctccttcctatagggcatggaagggatcaaggtgtttctccatgaaagagaactgtggctgaaatttcacgaagtgggcacagaaatgatcataaccaaggctggcaggtgagatggtcacctctgtggaggaggcatacggaacttgtgggagagatgaggaagaaagttgatgtgggagaccagagaaaggaggggagagagagaaggggggagagagagagaatgagggagagaaagaaaatgaatgtattttgttagactcgattctggttaaagagtcacggagatttcctccagccatctccatcagtggggtggtgggaatatctaaaaggttaaaccctggaaactgggtgtttcttccacctggtatataagaagaatcaagagctagagaggttgtgctatctggatgggtcagtaaccagaggtgggagaacgaacggcagaacagagaggggcacagacacacagagatgacactgggctttggatttcctgggatctcaggcttgattccttcccaccctctctgaccttggagtgggtccagagtctcaccggatcaccaaactcgggatccttgaatgtattcgctacctctttcattgtttatagaaagcaggcaaagcctttgaaactgaaccagggctcggcggggctctatatacagacaccgataaacagtttcgtcaagacactcaccctcttaaaagctcgctgagttttagtcagaaatgcgagacttctggcggagggggtgggagggtttgtgcagctccgtatctcagcgtgtcagtgtgtccggccatgcgcccaggcccgggacagcttcgccacatccctgctggtgctggacaggccctccgagtccctaagggcagaaagtcccagtctggtgcaggctggcggaagagccggtaggcccaagccaccgacagtgcgaagggggcgggtggagctgcctcgccagacgcccaccccttctccagcccaagcctcccgcaataaactgacaacagtgacatttattattatttgaaattaaacaatggctgctcccccgttcggcccgcgtgaactaggaggcgcgttctgtttataccaaagaactaaggtcctcttcctattccgccgggggaacgaaagacgcggccagggcctcgttttccccccatcctgagcggcagggatttaactataaaaggcctgcgaagcctccagcgcctccgcctccaggcgcgctagctagggcagataaacaccgcgaggcaaggctccaagggcagagggagagggctccgctcaccccttcccgccatcccagagcgagccaggttccagcaacgggtcctttggccccggccagccttaggaaggcgtgctggccgggggagccctcctcccaaggtgggatggagatggggagggcgccggtgcgcggagaaggagtgggctcagcgggaccgcgcaaccgccttccacccacccgatcctcgcgcagggcagagtctttctgaaatgagatttctttgcagagggcccaagcgtttagactcttctcccaggaagagcgccaggcgccttggagacgttattgggcatttagggataaattcctgcgggagaggagactcttatcagaggtcacacaccttgcgggtggaagactgaaaccccagcgcaaggtgtgtgggtacccatgcgcggttacagtcctagggcgcacccacctttgtgcccacgtgacacgtagcgctgggcatagcggccaaagtacctggctgggcggaggaagctaactttttttttttttttaaccgaataagccttttcctgcccccagataaacagagtaggtgtctggttctgaaatgagcattcagcaacggtttaaatgtggggtccctttcagggtttcttcaaaaccagtctttagaagccctcacctcttgctttctatttcctcctatagacaggcatagtcctagcctgcttttctcatcgcttggcccttctcctctccataatttgatgggaaacctggattggatcttggcaagagcaggacaggggctacttttctcttccacgtttctgaaaaggtggagtcttcagaatattttcattaattccctcccatctctgtctctgtcctcccacctctcccgtgtctcctaggcggatgtttcccagttacaaagtgaaggtgactggccttaatcccaaaaccaagtacattctccttatggacatcgttcctgccgatgaccacagatacaagttcgccgataataaatggtaggcaccagtgctggcaggtggggaaggcagggaggaatatgcaaaccaaacttccctctccccccgaaccaataaacatttttttggtgctcgtcctgtgtgctagaagtttttgctgcccattccactacatcctcctgacctcaccaagaagaaataaatagcagtcattagcccccattttatagatgagaaaaccgaggcttagaggaaggaaagagctgataaacatctgttcctgcaccagtgggttgtggatttttaaaaagggtattgttactaagcattggagctatttctcagggcataaaccattaacagttattttttatgagttacctgctttgaacatgccttttttatgaaattgcaaaatcggcccggggtatttgagttaaacaggcaagagaaaagaggctcattccttgggtacattgctcccgaggctgctaagagtcagaggcttgaagacgaagcccacccccccacctttgaaagcccacaaggcattttcccaaaactttcttgcacacacaggcttccagaacctgccagtttttcatgggcagagagatgctttgaggccaggctttctgggcatctggcattgcagatgtctgagcaagacttgggggtcaggccattttcagatcattcttatattcagcagctctcacctggtgcaagaaccaggcagccgcaaggtgcgctaagactaggcgggtggtacctctccttggtctaggtctgtgacaggcaaagcggagcctgccatgccgggccgcctctacgtgcacccggactcgccggccactggagcgcattggatgcggcagctcgtctccttccagaaactcaagctcaccaacaaccacctggacccgtttgggcacgtgagtacctcgtgcagcccttccttttgtatcttcaggcccgtgccttctctttctcacctgccctcttccccccccccgccccactcccttctccaggagtttctttctctttcggctcctcgtgcctacccatgcttctttttgtgctccatttcacctacgttggactttttctctctcagctttcttgacctggtcttcttgtcccctttcttttcctcttcctcatctctctttccatttcttttatttcttgcaccttctaacgcttcctctctgtctccacctctctcctacttcgacctctgctcctggcagtcctccctgtggtccatgctctgggtgtgtctttcctggggctcatcctgcatccctgctaccagcccccaacccttccgcctttgctgagggacagggtcgtgggggtgactaaagctgttccttccgggcctggaattcctgtttgttcagtcccatctgtgattagaggcagggggatgtgtttcggtcctgcagaaaacatgggccctctagctcagcaggtactcagcacagaccacagagtctggaccactggcgggagccatagaccttacctgcctccttccaaatcctgggatggtattttggggatgttacagctgcaaggaagaccctaggtcctctgtttcctcttttacaaatggggaaaccaacccactaggggcaaactccggaacctatgtcccctttagctcaatactcttgggtttatctgtttttttccaacttccagctctccccagctcctcccaccatgctcagagcagacaaacccagatcagggtcctacacctggaatctgaactggccccaagagagaggggcctggtgaactgactgaaactgcaggatttggagcatgcccccctcccccaagagagtgtgtaggttctagcaggttctccatagggtatgaccctctcttccccaaggaaaaagaatagaacactgatttaggggcaaatgtccctaaatctcttcattggaaagaatcaccaggacagaacagtgttttcaaaaccttagtttaatgattccatgtacaaatgggcttgtttgtcttagggtatttgatccttatagcagcctaaagagaaggatggaaatgcccacacatctttgcaattaggagtccagcagaaggaaggtgacttgcctcaggtcatatggcttgcatttgggaacaggaatttgaggctaggtttctctaattccagagaagtggtctctgtcctgccacttggtctctttatagagaatcgacagacaaaccctgttccccagtttggggatgtgaggagactggatgagaatgcatttaaccaggaagtcggccagttagtgagggtccaaatgagaaatctgcttttttttggtggggctttgggactgatgcaccaagcctgcagggtcccagctgcaaagaggaccacgaactgccactgatgcgttcagtttggctccacatgtggttggtgtgagattggactgctggccactggggaagagggaaggaaggcaggccccttctgtttccccgcagtaagaagggagcaaaggggacagatggggcgggccattgtgtgtggggggctttctaggcaagatgcagggcctcctttgcatttaaactgaggtgttttgcctgcagtggccagtttggggggcaccccagcccacagatgtgacctccaacttgtgtgggcgttggctggtgggtagtgccgtgtacctgtggatgctgagtggatgctttaggttaagtgctggaaccattttataaaggtcccaggtgcatgtccctttatgggggcctcctggaacctgggtgctgggaagcacgactgtcctccatcccatccctgatccttagccttccctctgcggccctgggtatgcctttgaggtcgcgctggggtggacgcctggggaaggcgtatgcacagcccctcaaccgagtctgaggcgcatctgagagtttcgggtccttctgcgccggcggactagggaaccgtgttctgagctcctccggactccccagctgccgcgcattcccacccggactttgagtccagagctgccctaatgaaattaagggccattagatcgtcttcgcgctgatgtctccacactgtccccggccgtcaaagcaatttggctaagccgggacgatggccgcgccggccgggggctgcggcggcccgcggggccccgctgcgtctctctgtcgccacgccgcccgggtcggcgtcgctatcggccagggaggcgaccgggccgcggcggccggagattagagccgagcagcccgggtcggggagccccggggtcccgagctttccccccctcccccggccgggtcgggccgcgccgcgccgcgctctcctccccctcccccaggcggatctcaagggttggccctagaaccctgccgcgggtcgggtcatcgatgcaaataatcgaagacacggagactactcccgccgttcagtttgcggtccgggggaaaaagcaggccaggttttcatctagggaaacgcggcagttcctccattcagtggatatagatcagaacgttttgataaatactagcgataccagcctcccaggatcatcaaaagcaaagtgtcatcagaaccacaaactcggttttattagtaaggatgttcatcttctctggatagttctgctccagcgagaatgtggtgcctgcagggtccctgctgatattgacaatggtggttgtactaatagtactgctacagcactgagaccccgtttgtcttcaggactcttctctaaccatggagaagataggaaggaaggagaaaaacattccccccaaaggagatgccgcagttctgtctggggccaagtctggagataattctgattgtggatcctgaaatgttgtaaagttggaggaagggaatgccaagggcagccaggcttctgttccatattaggggtgggggtgcttccttctcctcccccatcacacatccttagaagcccccctccccacaatttttctctctttttcattgactccactttgcacattctccaaagaccaaacctgtgatttctattccagttctgcaaatgcttggtcttttcctttgcatctctttgagctttttttgggggggggattctttgtatgtatttttgtttatgtatttgtttcttctcccctttcattccaaaactgttgcccagagaacctactgtatagcacaggaaaatctactcaatagttcgtaataacctatgtggggaaaaaagtggatatatttatatccactctttgctgtgctcctgaaagtaatactgtaagtcaactcaactccaataaaattaaatttaaaaaaagacaaaaaaggatacacagcaaacaaacaaaacaaaaaaccccccaagttattgcccaggctttcttggaggacaccagttccttgtcccaaaattgcttcactcccactgcagggggtggggtgttgagggggtagggaggttgggggtgggcagtgccctatgcagggagttaatttattaagcaaactttattaagaattctgatttactgccctgtgtgctttgggtagattcctggaatattaccctggctttttcagatggaaattgtcatttttgaaatgtttctttttaatgaaatcactggcttcttttcaaaaacaggggaaaaaaaatcagaccttttttcaagagcctatataaggaatctaattttggggtggagagtggggttttatggaaacaaaggggttttgattttccttacaatctcattttctttattatttttagattattctaaattccatgcacaaataccagcccagattacacatcgtgaaagcggacgaaaataatggatttggctcaaaaaatactgcattctgtacccacgtctttcctgagacagcgtttattgcagtgacttcctaccagaaccacaaggtaagcccagtacccaggaatctgccaacagggtgggggtggggaaccagcttgtttgccggaagctgcaggggtctcttgctaaaaccttaagctttatgggtacctttattcctcagcacagcaggcaccaactgctactccgggggctggggcagggactgagctgcagcctaagggtcgaagctgtttgtactgcattcacggagttggcacaaaacacacacacacgcacacaccaggtggaaacaaaattgtcaaactaaagatgaccacatggcatcaatgcagtactgagatgcaacaggaaggcatcccaatgcgctgaaatgatcagtggatagaaacacctttgcatgggctggctctgtactcttaggtgggggccaggtgccaccctcctggggccaccttttctcttgggatcagtctcctcctctccactctgccttttggatgcatttcaactccagttgggacagatagcacagttgctagacatcttgagcttggattttcccagatgctcccctcattgtttcagcaattcctgacccaagaccacatactcaagcaaggtgggtgttgctgaaacaaaaccaaaaccaaaaaaaaaacaaaaaaccagcaacctggatcacagctctggggactcagacaagatcctgcaaacacacagcttgatgaagggaggcgtgcctgcggccagtgcatcctttggtggctgcactatagggtagtggggggatggtacagatggcttgtgtcaccgtcagaaccccatgctgttcgaaatccaggcccccatttgggcattcagagcttgacaatggtattggtatacgtgctggcgccgaagcgagcacttgacaatggtattggaacagggtgccccgtaatcacaggttggggggagtaacttttattattgctcaggagaaagggcttgtcttgacttgtcacagttcatgtctgttctttagaaacccgggtgcacgtggattcattttattggagggagggcagcgctgaatgattcctaagacttgttagggaaagatctggaatctggaaaggcaagatacaggggctgggcaggggccattgccactgtgggttgtagactgttaggagtcttatgaagtgatttggggttagaaggctgtgagaggggaaagttgaggggggtggtccatatgcgatcagtgaaggcaaatcacgtggaccacttaccgagatggccatggggatggtgtgcccctccctctccacagagctcatccctccttaccttcgaggaaagaatgggggttggggggaagccacaggggcagtggggccaggcaggagaggccagggtggggtgagggaggagcctagcatcctaaagcctccagtcaccccttgaaggtcatttcatgcaggctgggcgttggataatacgcccccccccacccacagtgaagccagggcagttacgaaatactgtgggtaatcgccgaattcagattgtcagtgaccaggccaagtcatgatggatggtccctcccaggccacacggccagtctgggatcccaggcctcaagagagcttcctttcagcagaaaactcactccccctacaaatgcaattaactttctaaaggcaaagaaggacttttctttttaaagttcttcccgctcattgaaccaataagagaaaaaaaacaaaaacggtaaggtcaagtgccctgaaagttgcaacaccatttcaggctaatttgagttcggctgccagaagcctgtttcctctatggctgctgtaaacctatgtttaactttgtggtgatggccacagcaggaaaaatggaaaaaatagcaacccggactctcagttacatatatatatatatacacatacacacacacacacatatgtgtgtatatatatatacatatgcatacacgcacacatatacacatactgcttagtgtctcttagccctgacagagggtctaaaaatagacagatcttttttattcctgctaagaaaactcaggtccatacagagggaacagaagtggtagacacctgaaagtgacctgttaaagaaacctgtgggtgattcaggtcctttaggggaaattcctaagttctatgtagctctaagatcttaggggtccatcaggagtgggtctatctaggggaacacctgttctttctatttacaactttcttaaggcctgtcacacaataaattgcagtatttgatgtattcagttgaataggtttgacgtaggtatacacctatgaaagcatcactgttcccacttataaacatacacaacaccccctagacttatattttgaaaaaagtcttctccaaggaatatatttggtgatctgtgggtatggaggcgtgcctgcccagtagggtgtgtacgtgtgagtgtggaacacaatctaggagattgtgtgtctgtgtgctcatgggtctccaaacgtgagtctccaaatatgcatttggctatatgcagatgttgtggtttttgtgttttcttccagttttatcggggtataaatgatattcagccctgcatccatttaagatgtacagtgtcataatttgacttatctacatcatgaaatgatgatagaatgcattgagtggtggagataaatttgaaggccgcaaaggaatgactgattttctttattggttgagccagggagcccaggtgaactgtacatacaggtctttttctggttttgttttgtttttagggctgcaccagcagcatatggaagttcccaagctaggggtcaaattggagctgcagctgtcagccaacaccacagccacagcaatgcaggatccggccgcatctgagatctacaccgctgtatccttaacccaactgagcgaggccagggattgaacctgcatcctcatggagactatgacaggttcttaacgcccatgtaggtctttttaacgccagcccacatccagaagagggatttcctgggagacagctttcaatcactctcccccagatgaggtttcccccacttttttagtcattgaataccaaggcatttgattcgtttgtcaggagagaagtctaatgcggggcactttcccagttgaatccaggcccctgcacgcattccctgcacagatatatgatgtgtgacttatataagcgggtcaggttaagtgtgatttgtggactctgttttgttactttattgtcacacctggaaggagcgttgagatttctgacttcatgggtagaagccacctgagctcatgaaggattatggttgagagtctggaggcagactgcctgggttcagacccatttgacttggacaaattatttaactcagttttccccatctgtaaaatggatatcagaagagaatttttttggtattatcattgcaaggattaaaatgagataattcgtgcaaagtgtctcatgcagagcctggtgcagagtcaggagagattgttagtgatgattccattgattgagtacttaactgatccattgattaatagggcaactccattcaaaatgcaggtgctgaaaaactctttgaccaccctcttttagaatctgaaagatggagattttgttttgttttgttttttggccactcccatggcatgcaaaagttcatcatccagggatcgaacccaagtcacagcagcaaccggagccacaccagtgacaatgctgggtccttaacccactgagccaccagggaactccagagacttttgaataagttcttatttttgaggttgaagtacaactatacatgttagtctttgtggtttagttggttcattccctgatcgtgtcgtcaatccaaggcctgtttgcccagtattatgctttggataagtgctcggggaaagaaaagcagtctgtgtgattaaattgccaggacaatttggaaaaatacgagccaccagtttttggtccaaggggctcagtgcctccagactgatccctggatgcaggtaccaggtggcggcaggtaagtggcagggttcatatgtataccatggggttcctaatgacacagcctatttcctgagcgcagctgtgatcccaagctggatttgggagttatttccccagatggttgacagcttgaaaaagatatttaaatgctcgaatcttccccagcgacgttcactctgtgaaacacgtttttgtaaggttttcgcttcagttgtcagcagctctgagagcaatccctagaaatatttaggtgttaaaaaaaggtcacatgggcatttcatttccccacttttgcaacaatggctttgtatggcaagcttgtctctcccccaatattaacttactttgccattaaaaggcattttcctcctgcttaaatcattgtgtatggagcctgtatttatgaggtacgagctttctggttgggaccaggaaatgaactcctaatagagagacataattaagatttttggcccccgtgaggtgttttttttttttcccccaaaagcgagaattcacaacaattattctcattaatttttacaacctctgtctccctggttggagctggcatttatatttgcttttcccccccacccaaacccctcccccggatatccggtttaatgctgattttggagggaatacatttggatgacgaaaggaagtcagtttcagtggagccttttggtagaactcagacctccaggtgtatcggtttgtgtgcctgcgagtgactagtgccgtatgaggaagggaatttcatagagagcgtgataataagagaggggacaggaatgaaataagaggaacactttcacctgccctgaagcctgcaggttaacatttctcaggggtcgttcttatgcccagtaggcatctacactcaaatctacaaagcaggacataggtaagatccacgcatctaagtgcacatttagcaaatcatgcgtatcctgtgccatcatatttttggaagttatggtgataagagcaagaatcaggtagtagtagttaacctgtttgaggtataaagaatgggtttgaacacaagatttttgctgatgaaatacccaaacccacccttttctttccttttttattctttctttttagggctatacccacggcatatggaagttcccaggctaggagtcgaattggagctatatatagcctttggcttacaccacagctatagcaacgtgggatccaagcctggtcttcgacataagccacagctcacagcaatgctggatccctgacccactgagtaaggccagggattgaaccggcatcctcatggatactagtcgagttcattaccactgagccacaacgggaacgccccttttctttttttctcagggtaatttttttgttgcaagatctcggtggagcagtaacatcatggaacaggcattaattcagccctgatgccacccacccccttttttgtcttcagtatattcagaggttggcttctgtcactgggtggatgggggtgcagggagcagggaaagaactccctctactccttttaaaaaagatctagtttgtatttaacttatggagaatctcccccaccttaaaaaaatgatttatggtcatttgggttgcattttattgtcctaagagccgagtgagaaagcatgtcctattaggtgatgagcttttggagtcaagatagaactgggttgagaagtgtccattgcaagactgttttccaaagagatctttatggacttgtactcatcctgaagagccagttcaaaatatgagagttgcaggaatgggcagagtggaaaagatgagggaggagggagggagggatgaaaagtatttacatcagttttacttttcggagcagcttaaggttcatagtaaagttgagtggaaagtacagggggttcgtgtgtactcctgtcccccccaccccagcttcctccactatcaccatcccctgccagagtgggacattggttagcattcggtgaccctatactgacacatcatcacccagagtctgtcgtttgccttagggttcacgcttggtgttgtacacactctgtggctttagacacatgtataatgatgcatagtcactgtgctgtatctcacagaattgtttcgctgccttaaaaatcctctgtgcttctcttgtttcacccttcccttccttctgactctggcaaccactgatctctttgctgtttccctaattttgccttttccaaaatgtcatttggttggaatcatataacttttttttttttccccttttttggccatcccgttgcctatggagttcctgggccgggggtcagatttgagctgggttgtgaccacatcacagctgcggcaacaccaggtccttagcccactgagccaggctggggattgaacatgtgttctggcgctacagagatgccaccgatcccattgagccacagtgagaactcctcctataacatttaaaaaaatgttaattttaggagttccagctatggctcagtggtagtgaacccgactaatatctatgaggactcaggtttgatccccggccttgctcagtgggttaaggatccagcattgctgagagctgtggtgtaggtcgaagatgccactcagatcacgagttgctgtggctctggcctaggccagcagcagcagcagtagctgcagctccaattcaacgactggcccgggaacttccatatgctgtgggtgaggccctaacaaaaaaaggaaaaaaatgttaattttacatatattttttttgtgaactcacacgtacacatatagtaattatatgtgtgtgatagtcttggagttagaaggaagctttataagaccatctcttccgggaaacagaacataccagactgcttgcccccaaatagacaattatggggacattcattaattacgtctagtttcctaaaggagctacttggtttctcaaagtctataatgatagtactaagggcagaggaaacagttctgtgggtacttgaagatgatggaatcatggagagaaaattgttcttgttccagttatttttctatttatttctgagagagagagagagagagagagaggcttaccccagtaccagtttaggttaaatatttttctgaaagtgttgaatttccccttacaacaaagaggaggcaggctgtaggcttggaactttctgtgggtaccagcagagagaattcaatgtacctattttctttctatcaaatggcaaagctattccactttgacctacagagaagtgatataattttttttataaaataaatttaaataaaaatggcttgatttaaataaatatattggcgttccccttgtggcttagtggaaatgaatctgactagcatccatgaggatgcaggttcgatccctggcattgctcagtgggttaaggatctggctttgccttgagctgtggtgtaggttgcagacactgttcgaatctggagttgctatggcagctctgattggacccctagcctgggaacctccatatgctgtgggtgcagccctaaaaaaacaaaagacaaaaaataaataaataaaataaaatagagatgccgttggagttcttgtcgtggcacagtggaaacgaatctgactaggaaccaggaggttgcgggttcgatccccggcctccctcaaagtgttaaggatctggtgttgctgtgagctgtggtgtaggtcacagatgtggcacggatccctcattgctgtggctgtggtgtagggtgacagctgtagctctgaatagatccctagcctgggaacctccttatgccgcaggtgcagccctaaaaagcaaaaaaacaaaaacaaacaaacaaacaaacaaaaacttctctttaaataaaaatattggagttccctggaggcctagcagttaaggatctagcattgtcactgctgtggtgtaggtgtgatccctggcccaggaacttctgcatgctgcaggagtggaaaaaaaaaaaaattatgcaggccagtggacaggccctgaagagatgtgataatgatggtaaaggtgacctttgatgagtgctgccctggggtctcaaaagtgatctgatttatcaaaattcaattcatggagctcctgatgtggctcaacggtaataaaccccactagtatctatgaggatgtgggttccatccctggccttgcttagtgggttaaggatctggtgttgctgtgactgtggtgtaggttggcggctacagctccaatttgaccctagcctgggaacttccatatgccaagggtgtggctctaaaaagaccaaaaaaaaaaaaaaaagatcaattcacacgcagcttttaggaagttcttttacccaggtctgccactgtatgctcacacaaacagaatatgcgttaatggtttccaggaaggttctgggtcttgaaactaaagtgccagttctatcactatattgcaacaaaaagttctaagaagagggctctctcttctttacctagacaattaaagaggttaggctctgtttaatatatattagaactctaaatgttagtgtttattaaattagaccccattttccacctgaggtagcaaaccctatctgggaaattatgaaataaacatgaaatgagacatggtaggattttgagagcaatgatcaagtccttccaaatggagattgccacgctgcaggaagccaacacaatgtcaacatggtaccattttccaagggggaggggaggaccaagtgttgaggcctagattgtgtttgaaacacaaaatgctaagattaaaaacaaaacaaaaaagccaatccagccagagcaaggcagagtatgactccaattgatgggcaaaccgaaaccaggttatttttcccccttttaaaagctgtttgatctaggacatttttcaaagtcttctcatgaatgaagtggtgggtcccattgatgtgactggcttaatttgcttctttgggttgcctgaggctgcgtttccatgacacttactattagccgggacccaaggtagtcttgtaaatcatgtgaaaactccctttcctctgctttcagatcacccaattaaagatcgagaataatccctttgccaaaggattccggggcagcgatgacatggaactgcacaggatgtcaaggatgcaaaggtaagtcagttgcttcctgggctccctcctctctgcagccacccccgccctctgctcctcccccacccgtccccacaataacgcaggtgagccgacagccacagaagaccgggcacagagaaatggagccctggtcgccatcgtgaacaaggagaaagagccttttcaatcccattttctgataactttccacgtgatctcctccatcaggcaactcggatggagcttggagcatgagatggggacaggggtgagggggtgagtagaagagaatttgatcggtctctgtcggcctaggaaggaaagctacaatttccccctctttctccgctgtctctctccctctcgtgaagtccttctcgccttcttcccataagtcacaggcgatgaatgatttttctttttggcaaccgctcttggttaatggaagggaagttaatggcttgatttcctgggggtgattatgcagacagactcgacaccacatggtatccagggcactggaggtttggaagctggtggtaaaaattgcttggtatttgtacatatcctgtggtcacggtcgctgatatgatgaatagaaggggctgtggcaaatggacatagtgggaatttggtctgatttgattgttgccaattttgtcgaacattcccctctacctcttgataggcttccaaaataacttaccatatggcaagagaattagaaatacatcctgatccctttgaccaagaaaggtctttttctccccctctcccccttttggtgggtttagtgtttcaaaataaaatgaggtcattcaggaggcttttccttatcctttctggaagacacgaaaagggaaagttgggccgatggatagacatgctcaaaggagaacaagaagtttaagaaagagaaagagaaaaaggttgtggctttgtggttttaacgtgaggtttagaaatacatgccgtggaaattgttttcaggtagcaggcttaccagatctaattttgcatgcttttaaaaaaataaatgtactgttatcttcaggtgggacccgtacaccacacatgaatccctgccttcataactagtttccttcatgcttgtggatttgtaagacgctttttttgtgtgtggtgaaaaataaccaagttcttaaattattatttaaaaacacctttggccttacatgtctacatttggaaattggagttgggtttagtcttatggtcactggaaaaactgacaaatatcacagaaagctgaaagagaccaaactctttttggccctagtcttttggagtgccaagtttttatttctatgttgtctgtgagccccctccccattctgatggctgtctgtcatcagccattgatggacaaagacccctctctgttcttctgcaggtaaaggtccaggctgtgcagggagggactggtttcagcctgcaaccaaagggttttttccatctcccacttcttccctcctccttcccacaaggtcaagagcacatggtttcatgggcttaaggagttatggatcatcccttgaaatttaatcagtcaccaggtcctgtggagtctaccttcttcacatatatatcaggatttgcctacattctccacccaggctgtcttttccagccgtcaccatcctcatctgcccctgcctcctcacctcttgagacctgacttcagctctgttcccatccaggacaaactccaggcagctgctaaagacatctttgtaagacagatcagacacgcttacttcacagcctagaactctcccaggcctcctgtggccctcggcgtcaggtccagactcctttgcgtggctgaccacacccttcccatctggcctggctgagcccccgagctttcctcctctcccttcagtcatgctgaaggatctattccaaatctgtcttcctctgttgttttcatttttgtttttttaatttttttgttatagttgatttacaatgttgtgtcaatttctgctatacagcagagtaacccagtcctattcacacacacacacacacacacacacgtacacacgtgttctttttctcacattatcctccaacatgttccatcacaagtgattcagtataattccctgtgctatactagttttttttttttttttttcctttggcatatggagttcccagaccagggatcagatccaagccatagctgcaacctacaccacagcagcagcaatgctatatccttaacccactgtgtcgggccagggattgaacctgcattccagagctctagagaggccactgatcccattgaaccagattggaactccctcattattttttgagtaaaataacacctttagtctgcctcagtctgtctcctctcccgcacttcccgtggccatctcctgcccatcatcactaaggcttccctgtagctgtcctttcttccatgaagcttcccttggcagcagactttgtagtcagggtatgtctgttcccaggagccctcaggccagggcctggtgctctggaagctggttggacagatgatggccgtggaaggatagacaggtggggaggtacaggtgtttgagagctccgctcccctcaacacagctgaacaacacagctggctagatgttgaggcagatgactctactctgatctgaactggtgccctaaccatctcctagttgttgcggattggccgaggtctctttcctggataggcacttggagatggaaggaaggtaggttggttggtcttcagtagaaactcagggattaacgtgttggatcagaacgcccagcctcagagtcacatggatctttgtggccgccttaggagttgccttggagaacacaagggctgaactaactgttcaccaggctgagcgagtggacagggtcgattgcccggttctttagaggtggcccctggggaagagagcgagcaaagcagagagcctccaagaagctttggagtcagacaaaggtgggtcccatccttgccctgcacttatcagcacatgaccttggccaagggatttcacctcacagagcttcagtatcctcatctgtaaaatggacataaataaacatagtttccactttctgggggttcttgtaagaattatctaaacagtgcttggctcccagtccaccctccaaaaagtgatctgatttgggagaaaactcttcatgcctcctagttttgcccctgttcagaatttttcttctgggctgtagtcccagctcccaagttgcaggaggcagtgacaagtggggaagatggccctccggagacggccgtgataacagcctggctggaatggcaggctcactgttaatcttgtaatcctgtttcctgtcccccacacacccggtgacagctggctcagggagcaaagcagggggaatgaaatttcctctaattccaacaatcggacgaggggagaggggagggggagaggggtgaggttgtggagggctgagcattaactcaaagtgatcccacataaataacttttggattagcttggcaaatgtctgggccctcacctccacccttctcttcacccagcagtctgtgattggaaggtgcagagggtgtcttcattattttccaacatgtatgcatggtttctggtgacagccacaataacagcttattatgaaaatgggggagcgaaggaaaagcacagagaagaaaatgaaatcatttgcaaatcctgcctcgagccgactgattgaaatatgtgccaaggttatttggaaaggttaatctgtggcttagaaacatcttatcctaaaaaccaatatttcccaaattgcatgccccctcccctggtgacaaatgagatgatttcagagggcgcacgcagacacacaggcacatcagattgatttcatggaccttattgcttagaatgagactaggtcctaagaaagtagggaaagaagaaaaggagagagggagggaggagagttaaggctgattatttagggaaaatattaaccaaagagcagtggagctggtatgaagatctggaggcaattgtcaaggtgatgggcaaatcacagacatttgggagatacacctgggttcatcctaatgtgaaaagtgtgacagctttgctattgtttgaaatgatctaggccctggtttttcatagaacattgctttctttgaactttgccttgaactttcagatgtgctcagacaagttctgaacttcttaggagtcaaagatgttagtggcgtcaaggccagggccactggggaggtggggagaggatggagccgggccttgtgggatgaatgggatttgagtctgttggaaggaagggttttctgggtcggcatcagggaagaagtggatagggatctatctacatgtcttggacttgagaggaagggtcagagtctaaagatctctggaagctaggtggcatggcactgtgacaggggacactatgaggaggctcttcctagaagcacgggatgctagagatagaagggatcctaggaggcagcatctggaccaacctgcacccttgtgcagaagggggaaatgtggcctggtgactcatttatttatttatttctggccatgcctatgacatgtggaagttcccaggccagggatcgaacctgtgccacagcagtgacaaggccagatccttaatctgctgggccacctagggaggtcttatttcttcactctttgatccttggatctgttgctttcctcttaagctcacatgcatgtattcagtgcctgttccatgttaagtcctggggctgcaaaaggtaaatccacacagcgagcgaggggcagggggcacggatggtccagcaggctctggagctggggtccaggccaccacactgattaggccaggggctcctctacttcactgagcttctccttcctcctctgtaaaatgggggataattatagaacctccctccagggctgttgcatgggtgagaggaggtaatgtgtgtgtcctaattattactattgctatgaaacaattcactcctaaatttcaagtggacctgctgcgaaactctgggcttgccgtcagctctgtgtgggtgagacttgaaatctaggacagccagcactcctgtacccagcatccatgtctctgcagtccttccatgaggagctcagaggccatcacagggctctagatttcatccagttgtagcctgccagccctcaggaatgctctcaaaatactacttgtgctggaaaggccaggcgtcactcaccatcactgtgtgtgaagggaagccttggggagcactttggcttcccttgtgatgtgtgggtctggaatttgaagcgggtacttctgggtggttgttgcttgctgtcaggtgttggtggaagtggcaggtagttgaagtccaggcaaggctggatgcccaggatggtccaccccaccacccgtggttggcactggctcctggctgggagcccatctgggttgcccaagaggcctgtccagcatggcaggctcaagggagagggagtccctgcttggttggagtcgcagggcctttgctcacttgaccttgggaggctgtagtgtctcttctgctgcattctgttggctgaacagggctcactaagtgggcccagattccaggaggagaatagacatccctcctctagatagaaggggagccaaagagtaggcctgcatttttttttaaatttaaatgtattatttaaaaaattttatggctgcagctatggcatatagaagctcctgggccagggattgaacccgagctgtagttgtgacttgtgctggaacttcagcaatgctggatcctttaacgcactgtactgggctggggtatcaaacccatgcttctgcagtgacatgagccactgcaattggattcttaaccccctgtaccacagtgagaacttctgagcccacatgtgttaatactgccccaccatgtgcaggagctcctggtgcggtccctggcccagagtgatgctggagcatgtcaggtgttgagatgggatctgtgccctggtgaagctagaggccaggttgacctgccctagggccacacaaccagtcaaagtgcagaggctgggctgtgagcttgggcttcttccagatggagagaatcccctgtctgccctgccaggtggccactggctttggaatgacagacaagtaggcagagggctccccccagtaggcagagtaggcagagtaggcagagtgctccccccacgccccgcaccccagcagttctggctttaattcatgtagcatggcctcaagcaatgcctggtctttccatcagacacggcatttatggagcgttgtcaggggctagcagagtgtagggtgatggcctcagagctcttcatggaggaatcgaggcggcctccacctcctcaaccttttacaggactgccgatgccttggcaggaagtggtctctggggctggggtacccagagttgctgttcagctgacctggatcttgagcccccgcaagcagagagcagataggaaagcttagagccctgaatgtcccaggcagggtaaataggttgaggacatctctaccacccacctgagaaactggccattgtcccctctccgaagtgcctctgtcacctcctcctcttcttcctcgagggtgggggcttcttaatcggaatctagaatccctttggaggagttcccatcatggctcagtggttaacgaatctgattaggaaccatgaggttgcgggtttgatccctggccttgctcagtgggttaaggatctggcgttgctgtgagctgtggtgtaggtcgcagacgcgactcggatcccgagttgctgtagctctgatgtaggtcggcagctacagctctgattggacccctagcctgggaacctccatatgctgcaggagcggcccaagaaatggcaaaaaagacaaaaaaaaattaagatccctttggaaaatccaattaaagcaaggaactctgaaaaactcacaacatataagtagaaggaaaatgtcaaacaatgtcaagggattcatagggtccgggacccttgacaggttaaaatcattctattggagccatccctctggtttccagcccttccttcctgattttaaatgcatgttcagctccttaacctcactggtcagttttcaagtgggaggcttggtgctctggcgttcttatgcttgaggttaaaggtaacgggcaggtccaattaaggaggtgtgatttccaaaaccatattctggagacggcattaactccccactcctcgctgttcttttggctataggcatgtggctccccccccagaaaagtgtgaatttgtggcaaacaagaggagggttatgttcgagaggcctaagctgtgagatggtgctttgtcccaaggggtcccatcttgggtcctggttgtccatcgtgttcatcatcttctaactttttcccatttatctgtcacgctgtaccccccgcccagcgaacctcctcttcagggacagtgtctgtgggcaaatcacattaaagcagagtttctcaaacttttggcagacatcacaattagctgggaatgttaaaggagtgaatttctgggtcttaccttcaggggttctgaatcagcagctctagggaaggggtcagaagctggcctttaacaggttatctgctggagagggtcccctggtcacacctggattatcccttgcccctacaggacgaacaaagacatgcaggtaatgcatgattttatttttaggaaataaagcacatgtgttgggctgttgtatagaaaagaacatttttctctacttggtgctaaacttgagctgaacattagaagtacctggagtgtgtttcagtgttttattacgaaacatgtaagacatacagataacatagaattgtacacttagcacctttatacccactgatcaggctctacaattaatatgttgctatgtatttgctctaccacacatccatccaccaacctgtctgtccatccatccattcatccatccatccatccatccatccatccatccacccatccattcatccatccatccatccatccatccatccacccatccattcatccatccatccatccacccaccaatccatccatccatcttattcttttctgatgcatttcaaactcagttgcagacatgagtcctttcacccatgtgtaattcagcatgcatactattaactggcatctaagttttcgttcaagattctctactgcaggtaaaatttatatacagtgaaatgtgcggatcttaagtgaaccattcagttcttgacaaatgtacaaacctgtgaaacctaagccctgtcataagatagctggggccccttcactccagcacattccttcatgcccccttcctagttaattcctcctccccctctctaccagaaacaagcaatattctgattttttaaattatgggttaggtttgtctgttatagaactttatgtaaaaggaatcatatagtgtttctccttttgcgtaaggccttttttttttttccctcctggagagcttttaaaactccagtgtccaggctgtattgcagaacagtggcatcagtattaaaaaaaaattctccaggtaattacagtgtcagccaaatttgagactcacttctcaggagagattctcccatgtctgcccatccccaccttaagccctgtctctcaattatctcatcacagtagttaatgctatcacgttggaaatttgtttttgttttattctttgtttttctttttttagggctgcacccttggtatatggaagttcccaggctaggggttgaattggagctacagctgctggcctataccacagccacagcaatgccagatccaagccctgtctgcaacctacaccacagctcacggcaatgcaggatccttaactcactgagtgagcccagggactgggcctgaatccttatggatactagtcggattcatttctgctgcaccacaatgggaactctcaattttgttttttttaaggggtaaggcagaactctcaattttatgttagtccccagaacatttagcattcctgaagaagtggttgctttggggtgcctttgccaaggtcatcatttcactgatggtcaccaggaggtccttggcttaattcgtcatgaccgggggaccccccccccccgtgactccccatggaacagaggaggccttaagacaatcccttgagtgcaggaagcagtttcagaaaggtccctgtcccaagttagtccagatccctctggcctccagcttccggaaggacagagaaccagcctcagaaggcatctcttcaccttcccgccctccctccaaaattattaaaagacacagaagttccttcccatcgtggtgtggcagaaaccaatccgactaggaaccatgaggttgcaggtttgatccctgaccttgctcagtgggttaaggatctggcgtggccgtgagctgtggcgtaggttgccgacgcagctcggatcttgcgttgctgtggctgtggtgtaggccagcagctacagctctgattggacccctagcgggacctccatatgccctgggtgcggccctaaaaagcaaaataaataaataaaatttttaaaaaaccaaaattattaaaagatgcaaacagaaactactattggaatttgttctcactgtggcccagtgggttaaggatctgatgttgccccagctgtggtagaagtcacagctgtggctcagatttgatccctggcccaggaactttcatgtgccatggctgcagccccaccccccaaaaaaagaaaaaaaaataaaacttaccaccaccaacaaaaaacaaaactactaaaactaagacatggttaaactcgttcaaattgtcagttttatgagtctgatctaaagtatcgagcttttccatttagtcctagatacttggtaatgctctttgacacactaagcgcccatcaaaggtttcatctgtatggatctttcatggctgtggtgtaacatccagcttttacccaggggctcatgatgatactgcaaagtgggctttcttattcccatctgcagattggagaaactgaggcagatgtcgatgtcgtaactgtccatgcagctggtccaggacttttctcatgttgccagagctgcctctgtagtgtccctcaaaacctttttgtgattcacagacccctctcaagtagctaatgcaaggatggacctctccctagaaaaatggacaagcttctgttatctgatattaagggcggggaggtggggggagtcatagatcagttgaagcccttgcaaggtaagaacttgtgcttcaaaatagaatgaatgacgtgtggtttataagctggggtttattgagcagtgtgccccaactatatgctaaacttttcaagcactgtatcattcaaccctcccaagaggcagtgagtctgatcattcccattttacaagcaggagaccgaggctcagagaaaggaagaaattagccaaccccccagtggccaagttggtagcttggtaccaaaggaaggcacatgcatgctgaccagtgcctcaactcgaaacaaccccctggatatgaacttaatgtaggtcccattgtggcgcagtggagacaatcagactagtatccacgaggatgagggttcaacccctggccttgctcagtggatcggggatccggcattgccatgagctgtggtgtaggttgcagatgttgctcagatctgatgttgctgtggctgtggcataggcagcagttgtagttcctagcctgggaacttccacatgccatgggtgaggccctaaaaggcaaaaaaagagtagatatttaataagggaaccccaaggtctctaaccagagtggtcataaatggcaggtgctcagggccagagagctcagcgtccctgagtttcttgtgccactcagatcgctggttgaatcagtggtgggaaatccacataacctctctgtgttcccctggtcttaccagcaagatgggacagccagtggtccctgtgctttcctccggcttgctggcatgctgtgagttgagaaacaaaagggtcgcgaggcattttgtagacaagaagagggagcgattattatttgcagaggtaaaccccgtctggggtgagctgccccacctccccctttccccccttccctccagtgtccacacctcttagataacttccccaagtgtattagaaatcagaaaggctctcctgggattgccccccccgcttttcattttaatcacagattaaagtgctagtgagaggaggaatttgctccccgagaacagagattttacagtccccagccttgccccagtgtgctgctttagttgtttgagagagactgccagaaactgagtaagcatggccaggggaaaacaacaacagaaccttcccccccgcagcacccccgtacccctgccacctgctcccgtgaaaaggccaattcagtcggccgcggtggaaaacattctcaggggcattcgttagctggcagcgggctgcaatgcagtttggctgtggatttcaatattcccttgtaacgttttacaacccagacccggagacaatggcgtcattcatggcatccgctcacgtggaacagaatgtgagagcgaggcagagccggggagaagctggtctgtcagcagccctgacactcagggtgagctgaggtactcagggccctggttggttgtccagactgggcagagcatgtctgtgcctacaggatgtgagtagagctgttgatacagcggagagcagtgggatttgtaggactgattgacagtttgaccagtggaggttgatgttgcctgctgtagccaatagctgactgtcaccatagaggatgctctgtggaacagaatggtcgtgtcgcccaagcagcaatgggaaggcaacagtgtcctgttatcaaatatacattagcaagagcattggaataacaccgacccagggtgcagctcggctttacctcttctgagctgggtgatctggggcaagttgcttaacccctctgagcttcattttctctagctctaaagtaaatctaatcatgctgatgaaatgggattcttgccaggatccaatgagggaaagcctatcagtcaaccagcacagtggctggaacattaggacacgtgggaaaaaacaatgtggctggtgaggaagaagatgaggatgaggatggtgatggcgacagtggcgactaggctggtggtgagaaaactgtcccccgttgctgcccctcttcccagacacacaagggcttttcagctttcactttaattctctggtgccctggattcttcaaggatgctctcaaactctggaggaaaagagttcatcttctcatcacagggatttgagagacttcgctgtattgctactcactgagttcctttgattggtccaagatgagccccgggagaattatcccagtgttgtttgatggctccattttcttctctttgcctctgtaatcccatcctgattgagaagtcactccacccttcccgtgcctcgattttgacacctgtcagacagattgggggatgtggtgtttcctactccaagggagatacgctccattgacggtggggatgaggtttcaggctcctcggggagggaaacgcactgggagggacaagtggttatggggataatctggctttcccacttctgtgagtgtgagtaatcaaaagcagaatttggcccttccagagagcccttttgcaatttggcagtgccggaagggagaattccacggagtccattgatacattcgcttgtaaattccctcagccaacattttttaagagttattttctttaattaaaagaaaataaccatccccattaagaatatcaaactaaatgagatttccctcttcctattggatctctgacagcccggtacttgaactaaacaagacctagatagaatcgccagtgagatttgacaacttttatgttttattattataataatttttcttttttttccattacgtagcttgggctgccaagctggaacgctaaagctaatttcattccttccagcctcctggccccagggggagattctgagtggtggggatgctcatgacagctccagctttggttctgagatggcacagaccacgggaagctgggccaggggaccccagggtggcgggagggtgtctgtagcctcatggaaacttggctgactctccgttgtctcctgcctggttactgcgatgtgttttcagatgacaaacaaaggcaggggcccagcgtggagatcgtcatatcactgaggggtgggagaagtgggagaagagccttgggcccctgcacccctgcacccctaaaagtatattatgttttcaaaatcgaaagacgtcattaggagatttctcaaagtcattaggggactgttgggtcagaattctggttgtgtctctttctagctgtgtgatgccaggcaagttacttaatccctctgggcctcagttttccaatctgcaaaatgcagacaaaagcaatatccacttcttaggatcacagagaggatgaagtgggctggtgccgagggcatccttcaaaatgtgctgggtgtagtgctctttgtatgtgagatgatttcaggtgtactctttgattttaacaggtgcgagaggatctataactagcactacaaacccctactttaatggatgttattactcagagggaggctaaacttatttagataaagaattaaattttttttttttttttttttttggccgaacctgcagcatctggaatttcccagggccagggattgaacctgagccacagcaatgacattgcagagtcgttaactgctaggccaccagggaactcctagataaagaattaatgttaaggagttcccgtcgtggcgcagtggttaacgaatccgactaggaaccatgaggttgcgggttcggtccctgcccttgctcagtgggttaacgatccggcgttgtcgtgagctgtggtgtaggttgcagatgcggctcggatcccgcattgctgtggctctggcgtaggccggtggctacagctctgattcgacccctagcctgggaacttccatatgccgcgggagcggcccaagaaatggcaaaaaaagacaaaaaaaaaaaaaaaaaaaaaagaattagtgttaaaagtggagtaagttaaagaatagttggtccatggcaaaaaccacagcttagttcagaattttctgatatatatttcttctagggaggggtttttcccctgtttaggaccatgagcctctctggcagtctggggaagcttatggatgggttacgtctcagaatgatatgattaaatgtgtaaaataagatgccaagattgcaaaggaaaccaattatattcaaatatcgttatcaaagtcttttctaaatggcgatatagcaataaatgctcttaataaatgtcttaagtaacaggatctagtagcaggtcgaaaatgactgtaattttgaggtcgttttgagcataaatggcatctggagacacgtacagctgcaacgagagatgaaattattttgtttctgttgatgacagtcgctagggctgctaactcaactgtggctcattgcctgcacccatcacagaaagaaatactaaattccaatccaagattagtgaaaataaagacgtcattttggaaatccaagttcacacccctctgttttccccaaagttaagacctccaagttgaggagacaggctcatggaactgctgactctggagaaattttatgggctgaaagcacgagtcattttgtaactgcagacacgatggtttctactccatgccagatactttctagagtgcattgttggatggtttcaacaattttgtgagataactgactctcagagagattaaatgccttgtccaagatcccacagcgattagatgggagggctgatagggaatgcatattttcctgaagctcgctcatacctttattcttcccaagctaccctgattcttagatagttaagtaaaaatcagagtctggtgggttatcagggaagagaaggtaactggggaactcagcgaagaccgctgtggcttctccacactctttatattgtccccgtttcacagatgaggaaactgacgcttagcaaggcaactggcttcatctgagctcatggagttagcaaggacactttgggggtgcttcaggcttgatggggtggaggacccatttctgggggttgcatgaagattggacatttccctagatgtagtagcttttctggatccacagatgacttgagatcagatttgaatcctgttctgctcctctgcctcccaggcaaccctcttgaataagaaatgtggggggtactttgaatatcttcattttcattttgctttcatccaagttctcctgtgaatttcagctctgtttccattgccttttttcactggagatggggacatggggaggatgaatggacaccctggagggtcacaggtcacaccaggaggccataagcacttcttttatttgtgagtgtattcccccaagcctcgtcctcctgctctgctatactcataattatattaataattcatatactaattctgttaataataattgctattattttcaacatggaaatatttgtctaaacttcataaatgctcactataagaaacacagctcaggtcactgcagaggtgcaggttcaatccctggcccagcataatgggttaaaggatccagtgtggccacagctatggcttgaattcaatccctggctcgggaactttatggatgagccataaaaaagaaaaaaaaagagtcatgcaatgcagatgtgcagaaagtaataagttttcccataaccccagctcttggagggaaccactggtattcattccataatttagatcattttatgtcctatgtctttaatttatgttgcacagatttctgagtttgtgcatgtacagccttttcgttccttttaaaggctgcataatagtccatggctgagctctatcaaagttgacttaaccattaatgagaacatttaggttgtttctagttttttcctcttattctagacaatgctgcagagaaaatccttgcgcttatgtctttggacatggacctgaacagcttcttacaaaaattcataataatgggattcttgactctacattattgtgtgtattttttaaaaaatggatgccaacattctcttgtggtacgacgggttaaggatctggtgttgtcattgcagcagcttaggtttctgctttggcttcggtttgatccctggcctgggatttccacatgtcatgggtggggccaaaaaatgaatggagccatcaaactcccttccagaaaaggtgcagccgatcacccttccatcagcctacatgctgtaatagttactctcctgcgcaggattccccttccccgtccccaacggtggcagccccttcctcttagtagatgtgggaaagttatgggtcaggctgttctcttcttatacaccccaatggtttctctcaattctcccttttctctttgagccatccctcctctcagctcctctgcaaactctcactctggtccttcctccacccacctggtttcttttgggggctcttggcgatgcttagaactactttcctccattccaagagaggttctgttgattttcccaatatcttatgaggaaaaaataggactacctggtctgaaagctgtcagtaagagaaggagcatgagagtgtgagggaccagattttgagcactttggagaatgctctacataggcgtcataaactgaggctcagaaatgttgtggtccagaggtctgtaagtgatggagctgggatgtgaatctggagctacctggtcttagatctcatgcttggttctctgtctcctttgccctcctcttctttcttctccttttccttccctctctctcctcttccactctgtctccccagaactatgacagtcatgctgttgtcagacatttgtggagcactcactatgtgccaagtacagttctaagcctttaatatgtattgactaatttcttctctcaacaactctttgaaccggggatttttattatccctactttacagatgggaaaaccaaggcacagagaaattaagtattatgtcagtggagaagacaagcacagcagctcaaaagaaaattccaaggcacaagcagtcaactctccagattaggatagcctagggtcgtgcgtgactaccctaggtggtcagccaccattctctagtaatgctgggcaaagaccgaagctccatgttaaaggtggagaccagaggcgaagtctcagggaccttgcagcactttagcttttgaattacggaattcaaaaacatctagagtaggctgcaataattcaactgccctatgtatttactgtttgttaaaaggtgtcctgaggagtttctgtcttggcgcagcagaaacgaatacgactaggaaccatgaggttgggggtttgattcctggcctctctcagtgggctaaggatctggcatggctgtggctgtagtgtaggctagcagcaacagctctgatgagacccctagcctgggaacctccatatgccacgggtgcggccctgaaaagacaaaacaagacccctccccccaaaaaaggtgtcctgaactgggggtgctcattttcttttccacatacgtgtagaactactcttaaaactacttgcctgatgtatataaggcatgaaaagtgatgactgaatacatctgccacagcatatgatgcacttgatccctttctttctttctttctttctttctttctttctttctttctttctttctttcttttttgaccatacccatggtatgcagaagttcctgggccagggattgaacctgggctacagcagtaacctgagccatagcagtgacaatgccgagtccttaatggctagaccattggggaactccgatcctcttatttcttattctgtgattttttttttttctggtggattctttgaccctgtggttcagccagtgggaggctctctatcaggccactgatcaacgttactttgcatcttctctctttcagtaaagaatatcccgtggttcccaggagcacagtgagacagaaagtggcctccaaccacagtcccttcagcagtgagcctcgtgctctctccacctcatccaacttggggtcccagtatcagtgtgagaatggtgtgtccggcccctcccaggacctcctgcccccacctaacccgtacccacttccccaggagcacagccaaatttaccattgcaccaagaggaaaggtgagtgtgacagccctgccaactggctgctttctctacttgaagaaaaaaaggacacataaccacatgtatttactttaagaatataaccaatacaaaactgcagagagattgtaagaaattcaaaccattcgggtaatactagagattcctttgatatgtctcctccaagctctagccccttccttggggacagaccttattgaactggtgagacccatttatttgtttgtgcttgcacacacgcatatacaaagggttttgcttatacttttaacagttgatatcatactgtatgtattttgcaatatgcatttttttaaactttatagtacattgcagatatctttttgtgagcctccagtggcctcattctttttagctgctgaagaggaagtattgtttcaaatggatacagtggagtttatggtgccagtaatgaccagggagtctgcgttgtgttataaaccagtgtcttggttgtgttataagccatgctgcagggaactgccttcgaattagatgacttttcctcttattatctgagtccagagcagaggttaaggaaggaaatttctcttggcatgtttttcgagtcagaattgtaagggttgatgtgggcagtggggccagagaaacccagatttgagtctcggctctgccaccagcttcctgtgtgacctcaggcaggtgtcctagcccctcagtgcatcagtttctcacttcgtaaatagtgctgagttccttagagcaattggtacttggtaaacaccccgtgggtggcagttgtgatggaaaagtggcaggtatccttccagaaagtgagtcccggtaggaagtgaggagaagactgctcatccaggtgaaggctggggaagcaggacctaagaggaggggactgtgtaccctagggctcactcccatggctttcagagtcagacaagtgagatgagtcctagctttgccatttttaaatgtttatgatgaggggcaagttaggaaactcctctaaacctcactacaaaacatctctagaggagggaattcccattgtggctcagtgaaaatgaatctgactagtatccatgtggatgcaggttcaatccctggcctttctctgtgggttaaggatccggcattgctgtgagctgtggtgtaggtcgcagatgtggctcagatcccgagttgctgtggctgtggtgtagcctggcagctgcagctccgattcaacccctagcctgggaaccgccataggccatgggtgcggacctaaaaagacaaaacaaacaaacaaaaaacttgtatagaggagttgcctgcttcagtgcagtgggttaatgatccagcttgtctctgtggaggtgccagttcgatccccagtctggtgcagtaggttaaggatccagcattgccacagctgtagcgtaggttccagctgtggctcagattcagtccctggcccgggaacttccatatgatgtgggggtggccgaaaaagaaaaaaacaaactatagatttgggttcatgattggacctgcctcaaaggcttggtgtgaagatgtcatgaagccgtgcctgtcctgtgttcagcatagggtgaacttaataagccacccctgttttgctccagcaggcccaaatctcagtcttttgagtggcctgttgtacctcacagcattgacagccaacacgatgcctttcaaagtccagtgcctggtccctggaccatcttgggggaaaaaaaaaaaaaaaaccttactaaccaaaactgatggctggtgcctggaccatcttgaaaaaaatctgaacaactcactaaccagaaccaatgggaaaggatgctgtgctggctttctctgggtggggacataaggaaaggaacacactttgactctaggacattttcaaaaatcatgttttgaaggagggaagagctgtccttggtccaagcctggggctggggagctgacttggtgagactgagctttccaggcttacctgaagcccatgcaggctccttgggtctggagggactgagcaccgtcaccccaacaagccccctggcccgactcccagcacaacctctgccaggtgggccggagaccagatgcctgcaaacatgcctctccaggcacaagcaggggttaagaatgccccatggagctcaggtccctgcacagaggttctgttttgtgttatatttaagggtgtcctgcctgggttcagatcacaaccttttcaagaacgctattaagtagttgctattatgaacccactcgacaaatggcaaaactggggcttacaaagggaaaattgtgtctgatcattcttgaaggcagaatttgaatccaagcctggtctgcagactctgcttgggccctgaaccgtttctgcttctgttacctttgcgtatgagtgactgtctccagatttcatcctctactagagatctactcttgagattgggtcaaacatgccaattaagaactcaccaggtttggagttcctatagtggtgcagtgggaaggaatctgactaggaaccgtgaggttgcgggttcaatccttggcctcactcagtgggttaaggatctggctttgctgtgagctgtggtgtaggctgcagctgtagctctgattcgacccctagcctgggaacctccatatgccacagatgcggccctaaaaagcaaaaaaaacacaactcaccaggtttgaattaaagagttctttcaattaaattaatgtcagactaaaaaaaaaaaaaaaagaggaggaagttacagagaatcagggcactgtcttaggttcaggatttccagcagcatcattgtaagtgcagcaaaggatgcaggggaaagacttcaaaagcaaggctgatgaacctcttcaagtgatgtgaacagttggcttgtatggtgcttcgaggaatcctcgagtgacctagggatcaacttgaggtggccccaggggaggctgaattcagtggttggtccattgctgtatgtcccagcagtgtggtcatggataacttgcttcaactgttttctgagcctcaatccccttttctgcaacatggggttaataggagtacctacccagcaggtttgttatgagatgaaatgagatgatccaggtcaagcacccaaaagtgcctggtacctataagtccccgtgagctagccgctgccctgcccttgggaaactcacactgtcacaagcagctcagacattgtgtgactcattgtagtcttgtttgatgaagatggcaatcaaatgctataaaggagatatgcaaagtcctaacagaaatcaaagtggggggttcccattgtggctcagtgggttacaaacacaactaggatccacgaggatgtggtttcaatccctggcctcattcatcgggttaaagatccggcattgaggcaagtctcggtgtagtcacagattcggcttagattagacccctagcctgggaacttccatatggtgcaggtggggccctaaaaaaaaaagaaaaaaatcaaaatgggatattggactagggtggggtgtgggaaaggatttcagctgaggtctgcagagagtggaagttggaaaggagatgggggagtccagtctgtgtccaggtgtggaaagagtataagtgcagtcttttggaagatggggagcccgcttccactgggggagtggacgaaagcctggggtggctggaacccagagcaggggaaagtgatgagagatgaggctgctagggtaggcaaggaccagcacaatgccagctctcgtaagccattagagaagttcagattttatcctaacactgacatgtggccatggaaggggtttgaaccccttagtggtgagcagtgtgattctctctcctttttttttaatggttgcacccttggcatatggaggttcccaagccagggatcgaccaagccacagctgcaacctatgccacagccgcagcaactctatatccttaacccactgcaccgggctggggatggaacccatgcctttgcagtgacctgagctgctgcaatcggattattttatttatttatttatttattgtctttttgtctttttagggctgcacccgtgtcatatggaggttcccaggctagaggtctaatctgagctacagctgtacatctgccagcctacaccacagccacagcaatgcatgatccgagccgcatctgcaacctacaccacagcttatggcaatgccagatccttaatccactgagcgaggccagggatcgtacctgcaacctaatggttcctagtcggattcttttctgctgcaccatgatgggaactcctgcagctggattcttaatccactgcactatagcaggagctcattgggtttttctttggagcagtcactttgctgtgatagaattgatgccagggccctgttgagagcctgttgcaggctctgaggtgtgagatgatggtggctcagacctagctgtggagggaagagctggaggtgtgggggatctggacttcgggggtggctgcaggtaacgaggcgaagaactgcccctctctcatgaatgcagaaactgaggctcagagagactgagaaactggcctggagtccctctcagcttagggagcaactctgctcccaaatcatactgaggtctgtgctcttggggcgcagggctcttttcacctttacagaaacctctgcccttctcacctccctccaccccccaaaagggagctcccagggacagagaacattccagccaagctccgtctgtcctgcttgcctgcctcggagacgacaaaaagcaattcatcatcagcctccattgtaaagtgataaggaatcagccgaggtttccttccagtttgggattcccgttaagtgataactccatgggtggcttccacccctcacccctcacccccccgccccccccccgcccaccccggcccctgcctctgccccactatctgacttcccctcattgtctgtctcctttccagtgagccggggggcagccccaatgaaatgtcaaagggccaggcaggccagagggccccttgtgtttggacccagctgtctccaaactatctctcccgatggatggagccaagaaagctgggaaaagtcttttatcaatgccactcaatcaaagccaggaccccagggcctgggagagcacttgtctgtctttctgtcctccccctcccaccctgaccaccctccccaccattggaaaccagatgcaacccaaagaaagattttagctgagccacgtaccatactggatgctgaaagggaagcaggggtcattgggaggggggattgcagatagtagaggcttttgtattttcttggtctctactttttagtaactctccatcctctccatccttcactggatccccactgtggtcttggagccccagtagttgctgtacatcccattttgcaggggggcaagtagaggactaagagcttggttagagtcccaaggttatgtggccggggagtggcagatgtggaaggcattcatcgcagaaacagggattgcacgtttacttcacagtgggcactctgccgcatgctgaaggtaaggggggagcaagatggcagaggtctctgttcccaggacacttgtattctcatagaggggacagacagtaagcaaagtcagtcaatttcatggctcagggagtggctagctgaggtttaagctggagttttgattcaccatctgggatcttcccataataccataacatcccaggtctttttttgtgtgtgctttctagggccatacctgcggcatatggaagtccccaggctaggggttgaatcagagcttcagctgccggcttacgccacagccacagctttgtgggatccgagcctaatctgagacctacactacagctctcagcaacaccagatccctgacccacggagcgaggccagggatcgaacctgcatcttcatggatagtggtcagattcgttttccctgggcccaaaaggaaactccctcaggtcttttcactttaagctaagagcatggggacacacacatacaaaaaaaaaagaaaaagaaacaaaaatccatccatccatccataaaggtcaaggttactactttttcatattctttgaacacagtgggtttcaggaaaactgaaaggctgagccatctattcaaaagagcactgctttgggagtcagaaggcctgagttagagtcttacttctgacttgttgaaggtcattcagctaagcagtggcagctcacccctctgcctccagggtctctgtctctaagcgtccttcatctgaatgaactccaccaacaagaaaaatgacccatttgggaatggtgacaatatttgctcaatgagattagtgttttgaaagcagctctgtgagttttcgagctctggaatccacccaaataccttcaagtattggctgtccttcacagaaccacctatccagtcttccaagagggaaacgagaatcaacccatatcacttgggcagataagatttgaacactgactttatgtacaagaaagatagacagaaagtagactgtgcttttattatctcaattcctacatgaaatttacgtattattcccatgtataaacaagaactgagattggagtgtccagtggttcacccaaggtcacgtagcccctgagtcagagacataacacggtgccctaatatctgtgtcctggattcattattaaagccactttatccaggatctacagcatctagaaacatgcaaggcaccagggattttcacagtgctctgtggtgatcggcggtcggaatcaggaagagctttgcagttatccaagagactcagtggtgttccagacttttgaagtacagttgaccactcttacacaactttctgaaaccaagctgtgagctcgtctcatggaggacttgacccttgacgccagcctgttcctaaccgtgggagataaacaggacagaggtcttttgctgttgatcagttctcaggctcccaataaaaagaaagaaaccaaaccatcaccaaaataaacacagagattacatccccaagcatttatcacgaccaacgtgagatgtggatcctggctttggaatttctttacagtgtcacgaggaccaagaggcactgggaaacgctcaggtcctgtttgcatcaataagccagcatcgagtttttcttaggactctgcatcagcactttggggcattaaagactggaatgtgtaattttatgattttccaaaatgtgctctggcctttttcatattattcttccttttttacttgtaacaactctggaaggggatcagaaacttgggaatggttagtttgccttgttttttttttttttttcttttgccaagggtaccctgcagctgtactttctattattgaaaaggggaacgccctggttaaatggaaaacccaaaggttatgattccagcaataatggaaacattcagatttatggattgggggtgggggtggaaggaagaatggagggaaggaatcaagaggaggtggccaggacaaaaaaaagtccagtgtagcaatgtctttaagatgcactgctcccctaacccccctgaaaaaaacacacccagttgaaagatgaaaaatgtggccacttgctcatcgggatgtcttcgaacatctgcatagttggcatgatgtagctagaatacctggaaaagcggctgcattttttttcactgttttggggaccaatatttgggcgccctgtaggtcccaggtgcgtcccagaaagagtctggctaaaaataagtttgcttgctgttaggtgggtacaaccttggtgtagatgtgtgttgtttggggatatttttgacttacctgggggtatcacttggagaatgcggcaagtggaggtgtctggtggaagccatccccaagctaccctcctctcggtgggcagttggtttataatccagcacgaagccacaggacttactatggggagaatggctggcttggagcttgaaatccaaggcttacctgctgttcgcagagttcagcctcccactctcgctgcacagggagggggtgaagaggggccaggaggtgtgctgaatggtccacaactacccggcatggtacctggcaattgagtagaggactcaggtaatatctgttggatgatggggtgagtggtgttggatatgagaggtttggagagctggaagcaaggtgtgcccagcaaaagtgaatcagacctggtttgcttccagcttccgctccttcccaactgcatggccttgagcaggtgacttctctgagcttcggcttctgctgtcaaaaagggagactgaaaacagcctccttaaggaatgactatgagatgagaggcagatcacttagcaggtgctcaagaaataatagctcttttcccctcccttatttagtcctgtgttctgccttcataccatagactgtcattgtggtcacaattgtggggatgttcctgctatttcatttgtcgtcatgctccccacagacaggcatattccttaatgttactcattaggaagagagtggaagggagggaagaaaatctccagtttgaggagtaaaattccaaccaaggaatgaaccttgaggtttacaccttggtagaaaccccaagtattgcttcccctgaagaaaacacctggaggtgtcttattacagatgaggtctgtcaggatgcaggtggtggtgccctggcaacaagagctgcccgtagtgatggataccaggagatttacatgctcaattttatttcttagctgcccagggtggtacgtcctattaattcttattcaaagatgataaacaggagccccagagacaacagatgtcctgctggggtagcactgatgttaagtagaggagccagattcaaactcaagcatgtcagggcttcttaaccccagggtctgggttttaggaagccacctgcagttgtgtgcatcactttggtctatacatacagttcttaaaacttcctgtttcagcgtatttttctaggagagagcccagcattttcattagtccccaaaggggtcaggggccccagagaggtcaatggtgaccctctttcagagacagaactatctccactgctccaaactagggaataattaattagtgcctgcagggagttcctattgtggctcagcggtaaccaacccaactaatatttatgaggatgcgggtttgatccctggcctccctcagtgggttgaggatccaatgacactgtaagctctggtgcaggttgcagctacagcttggatctggtgttgctatggctgtggctgtgactggcagctctgagtggacctctagcctgggaacttccatatgctgcgggtgcggccctacaaagcaaaataaaaaaataaaaaaattagtgcctgcagtagggaagtgacttgctcagcaaggaaacagcaacatattaattcgtaccaactcaatagatattacctgcatccttgttcacataaggcatcaggaaaggatttggggatttattcgcgtgcccattcactgatccatttgtccatacatctgtccatgcattgcatgagtatttgttgcttgcctttctgtccagcatggcattgaagaaaaaggatttttttttacctaggtgactaggatttgaatcctagcttcactgtttataagccatgtaaggctgtttggcaagtttcttaacctctctgtctcctttctctcatctgtaaaatgaggatctaagggaacctgcctcgtagcggggttgagaagattaaatgggtgaccttacagagagtattcagaacagtgccaggtggtgtaaatgctctatgtgtttttatcatttttgttgatgctgttgttactatttttgttattagacaggtcccaggttctgggaatatcatgttgggtaatccagacaatgtccttccttcatggaatttacatgctggggaggagagaagataatactaataattgctatttattgagcatttccttgtgtcgacctctggactaggtgcttaatctatattttcccatttcattgtcaacacttccctttctagaaggttctattatgcccctttccattttacagatgaagaagcagagctagtttccccagtttactagaaactatataaagcattttttctaacgactgtcttaatgtcctactgtgggaatatactcatttttttttaaagagttctcattgtggctcagcaggttaaggacccagcattgtctgtgtgaggatgtgggttcgatcctggcctctctcagtggttaaggatccagtgttgccgcaagcggcaatgtaggttgcagatgcggctcggatccagtgttgctgtggctgtggtgtaggctggcaggtgcagctctgattagccctctagcctggaaacttctctatgtcacaggtatggccataaacagaaaggaaagaaggaaggaaggaaagagagagagaaagaaaggaaggacgaaagaaggaaactgagctcagaaaggtcaggctgtttgcttagaactctgtagcccatggtcttagccatgacagtccacccccttttgctcagaatggaggttggcgctgtcttccaggcataattcttcagcccttaggccaaatgtctgtctctgccttgagctgtggggtggctggtcctggcctcataggtgtctgtcctcctgtctcagcagatgaagaatgttccaccacagagcatccctataagaagccctacatggagacgtcacccagtgaagaggaccccttctaccgagccggctacccccagcagcagggtctgggtgcctcctaccggacagagtcagcccagcggcaggcctgcatgtacgccagctccgcaccgcccagtgagccggtgcccagcctggaggacattagctgcaacacgtggcccagcatgccttcctacagcagctgcacagtcaccaccgtgcagcccatggacaggctaccctaccagcacttctctgctcacttcacctcggggcccctggtcccccggctggctggcatggccaaccacggctccccgcagttgggggagggaatgttccagcaccagacctccgtggcccaccagcctgtggtcaggcagtgtgggcctcagactggcctccagtccccgggcagccttcaagcgtccgagttcctgtactctcatggcgtgccaaggaccctgtccccgcatcagtaccactctgctgtgcacggggtcggcatggttccagagtggagtgacaacagctaaagcgaggcctgctccttcactgacgtttccagagggaggggagagagggagagagacagtcgcagagagaaccccaagaacgagatgtcgcatttcactccatgttcacgtctgcacttgagaagcccaccctggacactgatgtaatcagtagcttgaaaccacaattcaaaaaatgtgactttgttttgtctcaaaacttaaaaaatcgacaagaggcgatgagtcccaaccccccctaccccgcccccaccatccaccaccaccacagtcatcaactggccacattcacacgacctccagatgccctccgggattccttcttttggtctccagaaagtcttgcctcatggagtgttttatcccaaaacatagatggagtcattccctgtcttggtgttactgttgacattgttatataataaataataatatatttttttctttcaattttcttaatgggacccagtcccttattttgggggaggtctgaggcaaatatgtttcaacatacttgcttgcggggttccccccaacacccatactccacccccccaaatctaaattcaccgagcctcccccttaactaagaaattacctacctctgccacgtgatgtttctgcaaagcttcctggtgtcccagcttctgtccgctttggtcctacctgccccctcctcaaggagtctagttctgccttctccccaccagtggagtcaggataaggctggaatccatcaggcgtcccatcttacccagccgtccagccgtcccagctcggtgtctttccagcctgctaaaatgtggcctatagcttccctaccggaaagagtgctttgaaaaacttaaaaagccccggtttacattcgggcagaactgtgataagcaaggcgaaagctctgtgctgacaagcgttgtgaaaaagccaaagtaaatactcgtccccatttaaaaaaaaaaaaaaaaaaaaaacaaccgaaaaaaacaaagccagcccccagcttccaaacctccatcgctgacgacctgacctggatgcctagatgcaaagccacatccacaacccccaaagaagaggcaagactgtactcactgatcagctctccccaaaggcatcacaccagcaccaaatgcagacacaaaactgtggttattgaaagcagaaaacggtgtttaaaaaaaaagtgtgtaagtaaaacattattgcagggttcttcagatgtaatattttcctggtactatttatttataaataggagttctaattaagtaataacgtgaaatgaaatccagcatgggagctggccaagagcttttaattttattgatactcaaaaccaagtttgcgttttttgtttttttgttttttcctttcagatgtgctttgctttcttgattaaaaaaagttgttgttttttttaactgaccctaataaagagaacagggtaatatgtgagactgcgtatgttcaagcacgtgagagtgtgtatgtttgtaatgtgagcgtctatgcgattatgtcgttatatgttgcgaagggggggggtaagaattaagtagtcgttcagtatatttgtgtgccaattaatgcctaataaatactgcgtgcttaaaaa

SEQ ID NO: 48 - DNA, 3727 bp, Homo sapiens
ctgtacatggagatcttgctgggaaaatccgcttgctcccctcacgtcgtccagcccaggagaaccaccgccgtcaccccggagcttcctcggccaccgcgcagagccctccgagagcccgagccgcggtcttcgagctccaaggctcattcagggccccagatccttgccccgaaaggagaggatctgagaaaatggatgcactgagacctctctgaaaaccctccgagagagcgcgagaggagcgaggacacgttactcgcagctaaaatcacatttaaggaccaaaacaacaacaaccaaaaatttcattaaaacaataagcgcccaagaacccagatcgggctggtggggggaggggaagaggcgggaaggggagggtcgcacggaggtagctttgcagtgagcagtcgaccccgccgccccccggcacagctggaccggctcctccagccgcggctcagactcgcccctggattccgggttagcttcggtgccaggaccgcggcccgggcttggattcccgagactccgcgtaccagcctcgcgggagccccggcacctttgtatgagcacgagaggattctgcctccgcgcagcagcccgggaagcaggagccgaagcgcgggccgtggagcaaggcgggaaccggaggcggcggcggcggcggccaggggcgcacggtgccaggaccagctcgccgcgccccatggggagccggcggccgcagcgctgctgaggcgggcccggctggccaggcggggggacggggcccgggctgcagcagccccctctgcggctgccgggcgggcccgggcgcccgggggctggggggtggggggtgggggaggacgccgagcgctgaggcaggggcccgggccgagggcgcggcggggctgcgcgcacgctggggcgcgtggaggggcgcggagggcgaaatgagtctggtaggtggttttccccaccacccggtggtgcaccacgagggctacccgtttgccgccgccgccgccgcagctgccgccgccgccgccagccgctgcagccatgaggagaacccctacttccatggctggctcatcggccaccccgagatgtcgccccccgactacagcatggccctgtcctacagccccgagtatgccagcggcgccgccggcctggaccactcccattacgggggggtgccgccgggcgccgggcccccgggcctgggggggccgcgcccggtgaagcgccgaggcaccgccaaccgcaaggagcggcgcaggactcagagcatcaacagcgccttcgccgaactgcgcgagtgcatccccaacgtacccgccgacaccaaactctccaaaatcaagaccctgcgcctggccaccagctacatcgcctacctcatggacctgctggccaaggacgaccagaatggcgaggcggaggccttcaaggcagagatcaagaagaccgacgtgaaagaggagaagaggaagaaggagctggtcagtaccagggggcggcaggcggtggggctgagggggtcagggaactggtgctcccggcctctttccaattgggctgagaaatggcatctcgtgttctttggctgcgtcccgcttcaaggttgtttgcaccaggttgtgtaaggatggcttccggcataagcagagagttgaggggagggtgtcagcaggaggaggagaaggttagggatgctttgcgctggtgatcttacctccgggttatcgctgctcccctagtacttaggacggaccttgaaaactctgggtcgcgatcgatcgcgatcgcactggtctggatgcctcaccccgtctctgttagacccttcttttggcctccaatccaatcttgctttcagatgtttccagaataagtctcgaagaagcccttgattccaattatttcactattgatcgcaccccctaccccactcccagaaggaggctgccagagactgagccctgagttttgtggttgttctcatactatgcccggaaaacgtaatggtaaacataaaataagtacttttgacttcaaaatacagctccaatttttccttggctatgacgttaaaatgtaatttcccagatgagtatattccattggcatttctaattttatttgaataagcctgtacattttaagggggaaaaggcattactatggtcattgttattaaaaataacacgaaagtaaattgagccgcttaaaattttctcagattcctaccaagtgcccacagggcagtggtgcaggatagagctatgtccacgaagggcccggaaaataattgcatttgtcgaatttttcttctttggcccctgcagccctttggtggctgcataatcgagtgacctcccgaataaccagagatttcagaagccttggaggagaggcactgctgagctggaggccgagagcctctggccgagaggcccaggccgaaacagaggctccttcgccctatttttcctagatgtggatctaggattgctaatgaaaacagagaaaccagacttagcgccgactccagctcccgcccctacatctggagtaagagaaaaggccccccgctcctccataaacgactcgaaaacgggcggttgtttataaacttgtggatccggttgttgagcgctgcagcgccgaggcctccccgccggctagggtagcgctaaccttggtagcttctctgcaggggctgggactcccccatcgtatcctttcctctctggttcactgtctcctccggcgcaggaagctccgggttggtgtggaaccaggtatcctctctgaatttctctttccacttttctcgccctcgcctttcctctgtccagaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcagacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaaagtggatatttgaagaaaagcattccatattttaatacgaagaggacactcccgtgtggtaagggatcccgtcgtctcatagattctgtgtgcgtgaatgttccctcttggctgtgtagacaccagcgttgccccccgccaacctactcaaccccttccagataaagacagtgggcactagtgcgtttgtgaagtgtatctttaatacttggcctttggatataaatattcctgggtattataaagttttatttcaaagcagaaaacagggccgctaacatttccgttggggtcggtatctagtgctatccattcatctgtggtcgttccctctttgaagatgtttccaacagccacttgttttgtgcacttccgtcctctaaaactaaatggaatttaattaatattgaaggtgtaaacgttgtaagtattcaataaaccactgtgttttttttttacaaaaaccttaatcttttaatggctgatacctcaaaagagttttgaaaacaaagctgttatacttgttttcgtaatatttaaaatattcagaagtaaactaaattatcatga

SEQ ID NO: 49 - DNA, 2891 bp, Sus scrofa
gggaggacgccgagcgccgaagcaggggcccgggctgggggcgcggcggggctgcgcgcacgctggggcgcggagggcgaaatgagtctggttgggggcttccctcaccacccggtggtgcaccatgagggctatccgttcgccgcggccgcggccgctgcggccgccgcggccgccagccgctgcagccacgaggagaacccctacttccacggctggctcatcggccaccccgagatgtcgccccccgactacagcatggccctgtcctacagtccggagtacgccagcggtgccgccagcctggaccactcccattacgggggggtgccgccgggcgccgggcccccgggcctgggggggccgcgcccggtgaagcgccggggcacagccaaccgcaaggagcggcgcaggactcagagcatcaacagcgccttcgccgagctgcgcgagtgtatccccaatgtgcccgccgacaccaaactctccaagatcaagacgctgcgcctggccaccagctacatcgcctacctcatggacctgctggccaaggacgaccagaacggcgaggcggaggcctttaaggcggaaatcaagaagacagatgtgaaagaagagaaaaggaagaaggagctggttagtaccaggggacggcgggcggtggggtgtgggggaccgagaatcccggtctctttccctttggcctgagcaatggcacaccgcgctctctgctgcatcctgagacaaggttgtttgcaccaggttgtggtcgagatggtttcccgaagaagcagaggaggtgggggagggtgtcagcacgcggaggaggttaagagggatgcttcgtgtgggtgatcttccctccgggtcattgctgctctccccccccccaacacccccccccgcaccccgctcccccgggcccttgaggcaggactcaggttccgaattgatcttctgatcgcactggcccggacccctcattttctgtcctttagagccttcatttggcgtccaatccgatcttactttcagatagttataaaataagttgtttagaagcgcttgattccaatgatttcactgttgatcgcattgtccccttttaagatcgaggctgccactgattctaagagagttttgtggttgttctgattactatgcccagttacgtaaaggttaacataaaatatgtacttttaacttcaaaatgcatctcgtttctctctggcagtgaagataaaatgtaacttcccaggcgactgtacttaaatgggcatttcttgttttgtttgcatgagcccatttaagacaaatggtaaatattaccactgtcattttatcgttaacaaaaatgaaaaattataactgaaaattagttttctcaagtacctaccaggtgcccatagggtagtggtgtttagagcagggctattcccatgaaaggcctgcaaaataatcccatttgtcaagttttccttcttggggcctgtggcgttttagttgctgcatagtcgagtgatccggggtaaccagggattttggaggccttggaggagagccgagccggaggccgagccaccggcagacaggcccaggcggaggcacttggcccatcttccctagagcgcagatctgggactgcgattgaaacagggaaaccagatttagcgccaacccccccgctcgcagccctacatctggagttaaagagaaggcccccagttcctccataaacgacttgaaaacgggtggttgtttataaacttgccgatccgggagttgagcctgcaggcttgcggaggcctgggcggtagcgagggcagagcaaggcttcatagctcttctgcaggggctgggactagaaaccatcacacccaccatcccttgctaactctctcagtctcttctggtcaggaaagcacgggggtggtgtggaaccaggttctcccttttaattttctctttctacttttctcaccctggcctctcttctgcccagaatgaaatcttgaaaagcacagtgagcagcaacgacaagaaaaccaaaggccggacgggctggccgcagcatgtctgggccctggagctcaagcagtgaggtggagaaggaggaggaggaggaggaggaagaggaggaggagagcgcgagccaggccctggagccggatgcagacccaggactccggggcgagctctgcgcactccgctctgaggacttcctgcatttggatcatccggtttatttatgtgcaatgtgcctccctctctttgcccccctttgaggcatccgctccccaccaccccctccaaaaaagtggatatttgaagaaaagcattccatattttaatatgaagaggacactcccgcgtggtaagggatcccgtcgtcgtcttgtagattctctgtttgtgaatgtttcctcttggctgtgtagacaccagcgttgctccctccccacctatccagccccttacagataaagacagctgataatagtgtatttgtgaagtgtatctttaatacctggcctttggatataaatattcctggggattataaagttttatttcaaagcagaaaacggggccgctaacatttccgttggggtcggtatctagtgctgccgtttcatctgtgtggttccctatttgaagatgtttccaacagctccttgttttgtgcacttccgtcctctaaaactaagtggaatttaattaatattgaaggtgtaaacgttgtaagtaatcaataaaccactgtgtgtttttttttttttacaaaaccccaatcttttaatggttgatacctcaaaagagttctgaaaacaaaactgttatacttgttttcattatatttaaaatattcagaagtaaactaaattatcatg

SEQ ID NO: 50 - DNA, 2569 bp, Homo sapiens
gagaagctaggggtgaggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatggtaaggccgggaccccaggaagtgaggaagttagggcggcgctcgggatatcagggacgcgtttccgagggcggggagctggccttgcgggaggtttgggccaggatccttcccgagagagaggacccccttgtcctgggcagctgtcactggggtagcctgttttggaagtgtgcgggcaagcgttcgagctgccccattgggggcgctattagaacactgcagcgcgaacgtgaagatctttttctctacttatccctacttccaaaatgtaaatttgcgccccttggtgactgtccgcccttggtttggccctgcatgttgcagacctcatctcctacccacccgtaattacccccccaaccaggacaggtctgggcccggaactagagccttaggctagagttagggagggggcggctacaggaattggtgttcgggcctcgagccgtcccgcgggcctgactcagtcgcccttgctgtttgcagatggactacagcggccccccgagcggcgcccggcggcggaactgctacgaaggcgcctactacaacgaggcgcccagcggtgggtattccgggcctctccctgctcgctcctcctccttcatggagctgtcctggcctctatctaggacgctcccacccccactcacacacgcctatgtcctgggaagtggtgcaggagatgaaatactaagcaagtagctccctgtcttttggattgtcccggactctaactaaagtcctcagtttccaatctgtctcaaagtactgggcccgggggtgggaggcttgtcgcggccccacccctgcttactaaccgagccctccccgcgcagaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttata

SEQ ID NO: 51 - DNA, 1715 bp, Sus scrofa
atggagctgctgtcgccaccgctccgcgacgtagatttgacgggccccgacggctctctctgcaactttgcaacagcggacgacttctatgatgacccgtgtttcgactccccggacctgcgcttcttcgaggacctggacccgcgcctcgtgcacgtgggcgcgctcctaaagcccgaggaacactcgcacttccctgccgcagcgcacccggccccgggagctcgtgaggacgagcatgtgcgcgcgcccagcgggcaccaccaggcgggccgctgtctactgtgggcctgcaaggcgtgcaaacgcaagaccactaacgccgaccgccgcaaggccgccaccatgcgcgagcggcgccgcttgagcaaagtcaacgaggccttcgagactctcaagcgctgcacgtctagcaacccgaatcagcggctgcccaaggtggaaatcctgcgcaacgccatccgctatatcgaaggcctgcaggcgctgcttcgcgaccaggacgccgcgccccctggcgctgcagcggccttttacgcgcctggcccgctgcccccgggccgaggcggagagcactacagcggtgactcagacgcatccagcccgcgctccaactgttccgacggcatggtaaggccaggactctgggccagagaagtgagggcagttctcggtatatcgccagtgtgtttccgagggagggcaaggagttggcccccagctgggagggttgggtggggaacgtttccgagagtgaaccccctgtgccccgggcagttgtcactgggttggcctagtgctttggggacgcacgggacggatgcgatccatccgattgagggcattatcagaacactgcagcgccaacacgaagatctgctttttcaccatttctccctattgtcaaaatgcagatttgtgctacgtgactgtctaccctctatttggctcggcaagctccagagagctcctgcctactcttccttcccaacccggacagatctgggcccggaactcttgtggctgacacttggggagttggggaaggggcggccacagggagtgatgctccagccctgcgcggttcccaagactaacctggtcgcccttgctgtttgcagatggattatagcggccccccgagcggtgcccggcggcggaactgctacgacggcacctattacagcgaggcgcccagcggtgcgtattctcaaccccttcccacattcccttttgagctgccctggcttctcttatctaggacctcctcgtccccatcctgggagatgatacagggaatgaaacactaagcctgtagttccttttctccgtgaaattttgcggcatcctcgcgaattctggctggcccccagtttcccgtctgccccaaagcactgagaccagaggtgggagcctagtccgccactccacccttgcatactaacctaccccttccccgcgcagaaccccggcccgggaagaatgctgcggtgtcgagcctcgactgtctgtccagcatcgtggagcgcatctccaccgagagccccgccgcgcccgcgcttctgctggcggacacgccgcgggagtcgtctccgggcccgcaagaggcggccgccgggagcgaggtcgagcgcggcacccccaccccttccccggacgccgccccgcagtgccccgcgagcgcgaaccccaaccctatctaccaggtgctctga

SEQ ID NO: 52 - DNA, 2740 bp, Homo sapiens
tctgcccttgttaattaccggagcgacagactagggagctccgcccgggatttgcccatcggcggaggcgccaggctcccgtttctccccatccctctcgctgccgtccaggtgcaccgcctgcctctcagcaggatggacgtgatggatggctgccagttctcaccttctgagtacttctacgacggctcctgcataccgtcccccgagggtgaatttggggacgagtttgtgccgcgagtggctgccttcggagcgcacaaagcagagctgcagggctcagatgaggacgagcacgtgcgagcgcctaccggccaccaccaggctggtcactgcctcatgtgggcctgcaaagcctgcaagaggaagtccaccaccatggatcggcggaaggcagccactatgcgcgagcggaggcgcctgaagaaggtcaaccaggctttcgaaaccctcaagaggtgtaccacgaccaaccccaaccagaggctgcccaaggtggagatcctcaggaatgccatccgctacatcgagagcctgcaggagttgctgagagagcaggtggagaactactatagcctgccgggacagagctgctcggagcccaccagccccacctccaactgctctgatggcatggtaagcaatagatctggtacctgctaggctaccctaatcttttctaaagtccttacacctcatttaacctggtgtggtggggagagtggggtggaggcagatgctgagttgctttaaaagaagagaggggtccacatttagaaagactccccaaaccgctgctgaacaagattttagtttaactttctagcaggttctaggtgtacactgtaatcgagtgttgacatggaagatgggtggctgtgaatgatcactcagatgttttctccattcctgaatttattttcaaaatatgccatctgtggatcatgccctacgctaatatctaaaggcaccgtttctaacttaatgaggaaatggaaagaaatacccacacggccccagttcctgctccaatgaggcctggctgaaagatgttgatgcattctttttagagggcgtttgctccaaggctgccaggttttaatgtgtttttgccctgggaaagtgttctttccctgaattagtgtggctttcttctactccaatccattttgcatggttaacccaatgcacattgctgctgaattccaccccctcttccctttgctgctgctctcctcttcttcaagcacagagattgacctcagtgccctgggaatttggagagggctagcccttcctaaatcaaggcagtgaaggtgattgacagtgttcggttacagagctggtgggcaagcacagcctcacctttggtcagaacatcttttgccaagacctgaaaacaaactttgttgtgtgtcttgtattatagcccgaatgtaacagtcctgtctggtccagaaagagcagtacttttgacagcatctactgtcctgatgtatcaaatggtaagaattgataacttcacaggagtttaaagaccagttcaacctaacaattcagcctataagattctgttcttgctgatagtattggggaagggagaatggaagtgatggttcttatagggaggctttggtaaagcaaaataaacacatcttctgctccaaatccccctagcagacacgcacgcacacatgcatacacacatgcacacacaatgttgcttgaaatattatcagggggcttccccactccccacgtctacccctcaggaattgccagatatttgttgcaaatttctatgttaggctttctgtgaccacctgacctctgggtgtcagaggagctgacctacaatttaaggagcaacataagcaaatctgtctatcttgggctaattattttttaatgcttttctccttgtatccttagtatatgccacagataaaaactccttatccagcttggattgcttatccaacatagtggaccggatcacctcctcagagcaacctgggttgcctctccaggatctggcttctctctctccagttgccagcaccgattcacagcctgcaactccaggggcttctagttccaggcttatctatcatgtgctatgaactaattttctggtctatatgacttcttccaggagggcctaatacacaggaagaagaaggcttcaaaaagtcccaaaccaagacaacatgtacataaagatttcttttcagttgtaaatttgtaaagattaccttgccactttataagaaagtgtatttaactaaaaagtcatcattgcaaataatactttcttcttctttattattctttgcttagatattaatacatagttccagtaatactatttctgatagggggccattgattgagggtagcttgttgcaatgcttaacttatatatacatatatatatattataaatattgctcatcaaaatgtctctggtgtttagagctttatttttttctttaaaacattaaaacagctgagaatcagttaaatggaattttaaatatatttaactatttcttttctctttaatcctttagttatattgtattaaataaaaatataatactgcctaatgtatatattttgatcttttcttgtaagaaatgtatcttttaaatgtaagcacaaaatagtactttgtggatcatttcaagatataagaaattttggaaattccaccataaataaaattttttactacaag

SEQ ID NO: 53 - DNA, 1850 bp, Homo sapiens
actgcactaattaaatgccatctgggtggttcctctgggtttttgagtccatcacccagttcagatcgagtcagaggccaaggaggagaacatgatgatggacctttttgaaactggctcctatttcttctacttggatggggaaaatgttactctgcagccattagaagtggcagaaggctctcctttgtatccagggagtgatggtaccttgtccccctgccaggaccaaatgcccccggaagcggggagcgacagcagcggagaggaacatgtcctggcgcccccgggcctgcagcctccacactgccccggccagtgtctgatctgggcttgcaagacctgcaagagaaaatctgcccccactgaccggcgaaaagccgccaccctgcgcgaaaggaggaggctaaagaaaatcaacgaggccttcgaggcactgaagcggcgaactgtggccaaccccaaccagaggctgcccaaggtggagattctgcggagcgccatcagctatattgagcggctgcaggacctgctgcaccggctggatcagcaggagaagatgcaggagctgggggtggaccccttcagctacagacccaaacaagaaaatgtaagcctagatgctgccggggcagggaaatgcgaaggctgattaaacgccttccgcggggccttaacctccagctgcttggtcttttttcccttccccctttctcgcccgcccctcccgctccgtctctaatgaacccccagtgacccaagaagaccgggtgcttgcaataggcaggaaatgcgtacccggcccgaggaagcaggaaagccgccccccaccccaccccaaccccggaaccgatgtttctttcctaatctgccgctgccttggttttccctccagcttgagggtgcggatttcctgcgcacctgcagctcccagtggccaagtgtttccgatcattccagggggctcgtgataacggctaaggaaggtaaagtaaaagggctctgggccgcaccagagaaaatccgggaggtggataggatgcttgggccgagagggctcgaagcgagagcagggacgcgccctgcgaaaagggcgctctttgcgcgccgggaccaggcctttcctcgctgccaaagcggcctcgcgcggggcgcggagctgcttcgtgttccttctttgggtgctatgtttgtgtgttgttttttcgctcaggaggagcaagtattgattcgtcagcctcgagtagccttcgatgcctttcttccatcgtggacagtatttcctcggaggaacgcaaactcccctgcgtggaggaagtggtggagaagtaactgagcctgcgcttgagaccttctccacgcagcaggaagatcccaccgacccttcctggcctaatcctttagattaggtcacattacattaacatttaggaacccagaccgaaaagttgctgaaagggaaggagacacattcacaaagaaacgttgcgaaaattgcgaaatctgttgtgcatgctcaaatgaaaacgcctttcggctttgggcttttatttttttggaactgcgagtggcttaggtctagcctcattttgtttttgtttggttggttttatactatattaacttttattacggtgatccttttgtgccatgttcaaaagaagttcattcctgtctaaagtgggaaagttgcatttaatgttaggggtatttaatgtatttttgtaaatagtttaacactttctttttttacgtaaacctgaaatatattttaaatgtggaatgatgtatataaaatgtgcgaggatcctggtattgtaatattaaaaagaagtttctatatgaacaaa

SEQ ID NO: 54 - DNA, 1854 bp, Sus scrofa
actaattaaatgccatctgggtggctcctctgggtttttgagcccatcacccagttcagaccgagtcagaggccaaggaggagaacatgatgatggacctttttgaaactggctcctatttcttctatttggacggggaaaatgttaccctgcagcccctagaagtggcagaaggctctcctttgtatccagggagtgatggtaccctgtccccctgccaggaccaaatgcccccggaagctgggagcgacagcagtggagaggaacatgtcctggcgcccccaggcctgcagcctccccactgccccggccaatgtctgatctgggcttgcaagacctgcaagagaaaatctgccccaaccgaccgcaggaaggccgccactctgcgcgagaggaggaggctgaagaaaatcaacgaggccttcgaggcactgaagcggcggactgtggccaaccccaaccaaaggctgcccaaggtggagatcctgcggagcgccatcaactacatcgagaggttgcaggacctgctgcaccggctggatcagcaggacaaaatgcaggagctaggcgtggaccccttcagctacagacccaagcaagagaatgtaagcccagacgccgccggggcaggggaatgcaaaagctgattagaagccttccttggggcctttacttccagctgctcctcttggttcccgtcccccttcctcgaccccaccctctcccaccccgctccccctctaatgaacccccactgacccgtgaacacggggtgcctgcaacaggcaggaaatctgtacttggcctgaggaaccaggggagacaccccccagcccccggaacgttgcttttgcctaatctgctgcctctctcttcctccagcttgagggtgcggatttcctgcgcacctgcagctcccagtggccaagtgtttcggatcattccagggggctcgtgatgactgccaaggaaggtaaagcaaaagggcactgggccccgcgggagaccatcccgggagggggctgggtgctcgctgggggcagaacgccccgggcgcctgcgggagccggtcccgccccgcgcgagccgagagcggaggcgccctcgagccgggcgctcccgccgcgcgcaccggcgcccgcgcccagcggcaccgcgggcggctcccttccgtggggttacgtttgtgtgcgtgtgtgtgtgtgttttctgcgcccaggagggacaaacattgattcgtcagcctcgagcagccttcggtgcctttcttccatcgtggacagcatttcctcggaggaacacacgctcccctgcgtcgaggaagtgggggagaaataactcgcggccggagacggtctccacgcagcagcaaaagcccaccctcctcctcctcctcctccgcctaatcctgtagatgaggtcacgttacgtgaatatttaggaaccctgactcaggagctcacgaaagggaaggggacatcttcgcaaagaaacttctcggaagctgttgcgcacgctcggaggagaagcctcgcagccttgggcttttcttcggcgaactgcgagtggcttagatctacagcagccttggtttttgctgggtgggctctgtaacatatttacgtttcctatggtgatccttttgtgccctgtgcaaaagaagttcattcctgtctaaagcaaagtgggaacgtcgcaactgttagtgggattgaatgtatttttgtaaataatcttagtactttcatttttttatgtcaacctaagaaatatattttaaacgtggagtgacgtattgtatacatagcgtgcaaggatcctggtattgttatattaaaaagataagtttctata

SEQ ID NO: 55 - DNA, 2119 bp, Sus scrofa
ggcttctccccgatctgatctatctcgcagctgcccaggtgcaccgcccgcctgtccgcagaagatggacctgatggacggctgccagttctcgccttctgagtacttctacgatggctcctgcatcccatcccccgagggcgagttcggggacgagtttgagccacgagtggctgctttcgggcgcacaaagcagacctgcccggctcagacgaggaagagcacgtgcgagcacctacgggccaccaccaggccggccactgcctcatgtgggcctgcaaagcgtgcaagaggaaatccaccaccatggatcggcggaaggcggccaccatgcgcgagcggagacgcctgaagaaggtcaaccaggcgtttgagacgctcaagaggtgcaccacgactaaccccaaccagaggctgcccaaggtggagatcctcaggaatgccatccgctacattgagagcctgcaggagctgctgagggagcaggtggaaaactactacagcctgcccaggcagagctgctctgagcccaccagccccacctccagctgctccgacggcatggtaagagaaagctcgggacctcctaggcccttctaatctttccaaaaaactttacctctcgtttaagccaggtgtagcaaccgaatattctgatagttggctgtgggggtgaggaggcagttgccctaagagagatgccccatttagacagacgccaggaaaccgctgctgaagagcataatactttgcctcccaagttctaggtgaacgttgccgggggaggttctcatgtgagacgggtggctgtgaatgatcagaggttttctccattactcactttacttccgatatataccccccgtggaccccaccgtacactaacgtttaaaggcaactgacggaggctccccatagcgcatggtttctaactctaggcagaaatgggatgaaacacccgcatggccccggttgctgctctgctgaggcctggctggaagatgttgatgcattcttttcagagggtgtctgctctaacgctgccaggttttaatgtgtttttgccctgggaaagtgttctctctccgaattagtgtggcttccttccaccccaatccattttgcatggttaacccagtgcacgttgctgccgaattccaccccgcccctctccttttctcccagtacagtgactgacctcagcgcccttgccatttggggaggcgagcccttcctaaatcaaggcagtgaaggtgactgagagtggtcaactttcgaagctggagggcaagcactgcctcaccctccatcagagcacctttcgccaagacctgaaaacaaatgccttcttttgtgtcttttattatagcctgaatgcaacagccctgtctggtccagaaagagcagcagttttgacagtatctactgtccgatgtaccaaatggtaagaacgaacgcctttagaggaggttaaagaccagttcaacttcacagttcagcccatcaaatcagtctgtccttccaggcagttatctggaggaaaagagaatggtttttacagggactttttggcggagcaaaataaacatctgctcaaaattcccctcagagatactcccatgcacacacacaggcacatgagcttttgcttaaaacattaccgagggtgcttctccactccccacctgcacccccatgaattgctagatatatatgttgcaaatttctacactggggtctctgtgaccacctgacctctgggtttcaaaggagctgacctgcagttcaaagggcaacgtaagcaagtctacctattgggttttttttttttttttttaacgttttttttttccccttgtatctttagtatatgccacggataaaagctccttatccagcctggattgcttatccagcatagtggatcggatcagcaactccgagcaacctggactgcctctccaggacccagcctctctctctccagttgccagcaccgattctcagcctgcaactccaggggcctctagttccaggctcatctaccatgtgctatgaactaaaaatctagtctagaccatttctgccaggagtgcctattacacaggaggaaggaggc

What is claimed is:

1. A method to increase the efficiency of human: non-human animal chimera generation comprising introducing one or more human stem cells into a non-human embryo, wherein multiple embryos are dissociated and the dissociated aggregate is layered with one or more human cells and cultured prior to transfer into a synchronized surrogate, wherein the aggregated embryo and cells results in increased efficiency of chimera generation, further comprising knocking down or out the expression of TP53 in the one or more human cells, wherein the one or more human cells are induced human pluripotent stem cells (iPSCs).

2. The method of claim 1, wherein TP53 expression is knocked down.

3. The method of claim 1, wherein one or both alleles of ETV2, NKX2-5, HandII, TBX5, MYF5, MYOD, MRF4, IL2Rgy/-, RAG2-/-, IL2Rg-/-;
RAG2-/-, IL2Rgy/-, RAG2-/-, IL2Rg+/-, RAG2+/-, IL2Rgy/+; RAG2+/—, IL2Rg+/-;
RAG2+/-, DGAT (diglyceride acyltransferase), ABCG2 (ATP-binding cassette sub-family G member 2), ACAN (aggrecan), AMELY (amelogenin, y-linked), BLG (progestagen-associated endometrial protein), BMP 1B (FecB) (bone morphogenetic protein receptor, type 1B), DAZL (deleted in azoospermia like), Eif4GI (eukaryotic translation initiation factor 4 gamma, 1), GDF8 (growth/differentiation factor 8), Horn-poll locus, IGF2 (insulin-like growth factor 2), CWC15 (CWC15 spliceosome associated protein), KissR/GRP54 (kisspeptin), OFD1Y (Y-linked oral-facial-digital syndrome 1 pseudogene), p65 (v-rel reticuloendotheliosis viral oncogene homolog A), PRLR (prolactin receptor), Prmd14 (PR domain containtin 14), PRNP (prion protein), Rosa, Socs2 (suppressor of cytokine signaling 2), SRY (sex determining region of Chr Y), ZFY (zinc finger protein, y-linked), β-lactoglobulin, callipyg (CLPG), MODY 1 (HNF4α) (hepatocyte nuclear factor 4, alpha), MODY 2 (GCK) (glucokinase), MODY 3 (HNF1α) (hepatocyte nuclear factor 4, alpha), MODY 4, MODY 5 (HNF-1β) (HNF1 homeobox B), MODY 6 (eurogenic differentiation 1), MODY 7 (KLF11) (Kruppel-like factor 11), MODY 8

(CEL) (carboxyl ester lipase), MODY 9 (PAX4) (paired box 4), MODY 10 (INS) (insulin), MODY 11 (BLK) (BLK proto-oncogene, Src family tyrosine kinase), APC (adenomatosis polyposis coli), ApoE (apolipoprotein E), DMD (dystrophin muscular dystrophy), GHRHR (growth hormone releasing hormone receptor), HR (hair growth associated), HSD11B2 (hydroxysteroid (11-beta) dehydrogenase 2), LDLR (low density lipoprotein receptor), NF1 (neurofibromin 1), NPPA (natriuretic peptide A), NR3C2 (nuclear receptor subfamily 3, group C, member 2), p53 (cellular tumor antigen p53-like), PKD1 (polycystic kidney disease 1), Rbm20 (RNA binding motif protein 20), SCNN1G (sodium channel, non-voltage gated 1 gamma subunit), tP53 (tumor protein p53), FAH (fumarylacetoacetate hydrolase), HBB (hemoglobin beta), IL2RG (interleukin 2 receptor, gamma chain), GGTA (bifunctional cephalosporin acylase/gamma-glutamyltranspetidase), VASA (vasa protein), MIWI (piwi-like RNA-mediated gene silencing 1), PIWI (CG6122 gene product from transcript CG6122-RA), DCAF17 (DDB1 and CUL4 associated factor 17), VDR (vitamin D receptor), PNPLA1 (patatin-like phospholipase domain containing 1), HRAS (Harvey rat sarcoma viral oncogene homolog), Telomerase-vert, DSP (desmoplakin), SNRPE (small nuclear ribonucleoprotein polypeptide E), RPL21 (ribosomal protein), LAMA3 (laminin, alpha 3), UROD (uroporphyrinogen decarboxylase), EDAR (ectodysplasin-A receptor), OFD1 (oral-facial-digital syndrome 1), PEX7 (peroxisomal biogenesis factor 7), COL3A1 (collagen, type III, alpha 1), ALOX12B (arachidonate 12Olipoxygenase 12R type), HLCS (holocarboxylase synthetase (biotin-(propionyl-CoA-carboxylase)ATP-hydrolysing)) ligase)), NIPAL4 (NIPA-like domain containing 4), CERS3 (ceramide synthase 3), ANTXR1 (anthrax toxin receptor 1), B3GALT6 (UDP-Gal: betaGA1 beta 1,3 galactosyltransferase polypeptide 6), DSG4 (desmoglein 4), UBR1 (ubiquitin protein ligase E3 component n-recognin 1), CTC1 (CTS telomere maintenance complex component 1), MBTPS2 (membrane-bound transcription factor peptidase, site 2), UROS (uroporphyrinogen III synthase), ABHD5 (abhydrolase domain containing 5), NOP10 (NOP10 ribonucleoprotein), ALMS1 (Alstrom syndrome protein 1), LAMB3 (laminin, beta 3), EOGT (EGF domain-specific 0-linked N-acetylglucosamine (GlcNAc)), SAT1 (spermindine/spermine N1-acetyltransferase 1), RBPJ (recombination signal binding protein for immunoglobulin kappa J region), ARHGAP31 (Rho GTPase activating protein 31), ACVR1 (activin A receptor, type I), IKBKG (inhibitor of kappa light polypeptide gene enhancer in B-cells, kinase gamma), LPAR6 (lysophosphatidic acid receptor 6), HR (hair growth associated), ATR (ATR serine/threonine kinase), HTRA1 (HtrA serine peptidase 1), AIRE (autoimmune regulator), BCS1L (BC1 (ubiquinol-cytochrome c reductase) synthesis-like), MCCC2 (methylcrotonoyl-CoA carboxylase 2 (beta)), DKC1 (dyskeratosis congenital 1, dyskerin), PORCN (porcupine homolog), EBP (emopamil binding protein (sterol isomerase)), SLITRK1 (SLIT and NTRK-like family, member 1), BTK (Bruton agammaglobulinemia tyrosine kinase), DOCK6 (dedicator of cytokinesis 6), APCDD1 (adenomatosis polyposis coli down-regulated 1), ZIP4 (zinc transporter 4 precursor), CASR (calcium-sensing receptor), TERT (telomerase reverse transcriptase), EDARADD (EDAR (ectodysplasin-A receptor)-associated death domain), ATP6VOA2 (ATPase, H+transporting, lysosomal VO subunit a2), PVRL1 (poliovirus receptor-related 1 (herpesvirus entry mediator C)), MGP (matrix Gla protein), KRT85 (keratin 85, type II), RAG2 (recombination activating gene 2), RAG-1 (recombination activating gene 1), ROR2 (receptor tyrosine kinase-like orphan receptor 2), CLAUDIN1 (claudin 7), ABCA12 (ATP-binding cassette, subfamily A (ABC1), member 12), SLA-DRA1 (MHC class II DR-alpha), B4GALT7 (xylosylprotein beta 1,4-galactosyltransferase, polypeptide 7), COL7A1 (collagen type VII, alpha 1), NHP2 (NHP2 ribonucleoprotein), GNA11 (guanine nucleotide binding protein (g protein), alpha 11 (Gq class)), WNTSA (wingless-typ MMTV integration site family member 5A), USB1 (U6 snRNA biogenesis 1), LMNA (lamin A/C), EPS8L3 (EPS8-like 3), NSDHL (NAD(P) dependent steroid dehydrogenase-like), TRPV3 (transient receptor potential cation channel subfamily V, member 3), KRAS (Kirsten rat sarcoma viral oncogene homolog), TINF2 (TERF1-interacting nuclear factor 2), TGM1 (tranglutaminase 1), DCLRE1C (DNA cross-link repair 1C), PKP1 (plakophilin 1), WRAP53 (WD repeat containing antisense to TP53), KDM5C (lysine (k) specific demethylase 5C), ECM1 (extracellular matrix protein 1), TP63 (tumor protein p63), KRT14 (keratin 14), RIPK4 (receptor-interacting serine-threonine kinase 4), PRKDC (protein kinase, DNA activated, catalytic polypeptide), BCL11a (B-cell CLL/lymphoma 11A (zinc finger protein)), BMI1 (BMI1 proto-oncogene, polycomb ring finger), CCRS (chemokine (C-C motif) receptor 5 (gene/pseudogene)), CXCR4 (chemokine (C-X-C motif) receptor 4), DKK1 (dickkopf WNT signaling pathway inhibitor 1), ETV2 (ets variant 2), FLI1 (Fli-1 proto-oncogene, ETS transcription factor), FLK1 (kinase insert domain receptor), GATA2 (GATA binding protein 2), GATA4 (GATA binding protein 4), MYF5 (myogenic factor 5), MYOD1 (myogenic differentiation 1), MYOG (myogenin), NKX2-5 (NK2 homeobox 5), NR4A2 (nuclear receptor subfamily 4, group A, member 2), PAX3 (paired box 3), PITX3 (paired-like homeodomain transcription factor 3), Runx1 (runt-related transcription factor 1), RAG2 (recombination activating gene 2), GGTA (bifunctional cephalosporin acylase/gamma-glutamyhtranspetidase), HAND1I (heart- and neural crest derivative expressed protein 2), TBXS (T-box 5), ETV2 (ets variant 2), TBX4 (T-box 4), ID2 (inhibitor of DNA binding 2), SOX2 (SRY (sex determining region Y)-box 2), TTF1/NKX2-1 (NK2 homeobox 1), MESP1 (mesoderm posterior 1), NKX2-5 (HK2 homeobox 5), FAH (fumarylacetoacetate hydrolase), SALL1, PRKDC (protein kinase, DNA activated, catalytic polypeptide), RUNX1 (runt related transcription factor 1), FLI1 (fli-1 proto-oncogene, ETS transcription factor), PITX3 (paired-like homeodomain transcription factor 3, DKK1 (dickkopf WNT signaling pathway inhibitor 1), FLK1 (kinase insert domain receptor), BCL11A (B-cell CLL/lymphoma 11A (zinc finger protein), RAG2 (recombination activating gene 2), RAG1 (recombination activating gene 1), IL2RG (interleukin 2 receptor, gamma chain), c-KIT/SCFR (v-kit hardy-Zuckerman 4 feline sarcoma viral oncogene homolog), BMI1 (BMI1 proto-oncogene polycomb ring finger), TBXS (T-box 5) and combinations thereof are disrupted in said non-human embryo.

4. The method of claim 3, wherein ETV2 is disrupted.

5. The method of claim 3, wherein ETV2 and NKX2-5 and HandII are disrupted.

6. The method of claim 3, wherein NKX2-5 and TBX5 are disrupted.

7. The method of claim 3, wherein HandII and TBX5 are disrupted.

8. The method of claim 3, wherein NKX2-5 and HandII and TBX5 are disrupted.

9. The method of claim 3, wherein ETV2 and NKX2-5 are disrupted.

10. The method of claim 3, wherein ETV2 and NKX2-5 and HandII OR NKX2-5 and TBX5 OR HandII and TBX5 OR NKX2-5 and HandII and TBX5 are disrupted.

11. The method of claim 3, wherein MYF5, MYOD, MRF4, ETV2 or any combination thereof are disrupted.

12. A method to increase the efficiency of human:non-human animal chimera generation comprising introducing one or more human cells into a non-human embryo, wherein the one or more human cells has reduced expression of TP53; wherein the reduced expression of TP53 results in the increased efficiency of chimera generation as compared to generating a human: non-human animal chimera with one or more human cells with wild-type expression of TP53.

* * * * *